United States Patent
Osada et al.

(10) Patent No.: US 8,980,587 B2
(45) Date of Patent: Mar. 17, 2015

(54) PROCESS FOR PRODUCING REVEROMYCIN A OR A SYNTHETIC INTERMEDIATE THEREOF, PROCESS FOR PRODUCING COMPOUNDS CONTAINING A SPIROKETAL RING AND NOVEL ANTINEOPLASTICS, FUNGICIDES AND THERAPEUTIC AGENTS FOR BONE DISORDERS

(75) Inventors: Hiroyuki Osada, Wako (JP); Shunji Takahashi, Wako (JP); Makoto Kawatani, Wako (JP); Yoshiyuki Sakaki, Yokohama (JP); Atsushi Toyoda, Yokohama (JP)

(73) Assignee: RIKEN, Wako (JP)

( * ) Notice: Subject to any disclaimer, the term of this patent is extended or adjusted under 35 U.S.C. 154(b) by 0 days.

(21) Appl. No.: 13/819,959

(22) PCT Filed: Aug. 30, 2011

(86) PCT No.: PCT/JP2011/069660
§ 371 (c)(1),
(2), (4) Date: Feb. 28, 2013

(87) PCT Pub. No.: WO2012/029811
PCT Pub. Date: Mar. 8, 2012

(65) Prior Publication Data
US 2013/0177950 A1    Jul. 11, 2013

(30) Foreign Application Priority Data
Aug. 31, 2010   (JP) ................. 2010-194222

(51) Int. Cl.
| | |
|---|---|
| *C12N 1/21* | (2006.01) |
| *C12P 17/06* | (2006.01) |
| *C12P 17/16* | (2006.01) |
| *C07K 14/36* | (2006.01) |
| *C07D 493/10* | (2006.01) |
| *C12N 15/52* | (2006.01) |
| *C12P 17/18* | (2006.01) |
| *C12N 1/20* | (2006.01) |
| *A61K 31/351* | (2006.01) |

(52) U.S. Cl.
CPC ............. *C07D 493/10* (2013.01); *C12N 15/52* (2013.01); *C12P 17/06* (2012.01); *C12P 17/181* (2013.01); *C12N 1/20* (2013.01); *C07K 14/36* (2013.01); *A61K 31/351* (2013.01)
USPC ........... 435/125; 435/155; 435/136; 435/142; 435/135; 435/320.1; 435/252.35; 536/23.1; 536/23.7

(58) Field of Classification Search
None
See application file for complete search history.

(56) References Cited

U.S. PATENT DOCUMENTS
5,322,854 A    6/1994 Isono et al.

FOREIGN PATENT DOCUMENTS
| | | |
|---|---|---|
| EP | 0491956 A1 | 7/1992 |
| EP | 1650210 A1 | 4/2006 |
| JP | 04-049296 A | 2/1992 |
| JP | 07-223945 A | 8/1995 |

OTHER PUBLICATIONS

Woo et al., Reveromycin A, an agent for osteoporosis, inhibits bone resorption by inducing apoptosis specifically in osteoclasts, Proc. Nat. Acad. Sci. USA, 2006, 103, 4729-34.*
GenBank, Accession No. AB568601.1, 2011, www.ncbi.nih.gov.*
Malpartida et al., Molecular cloning of the whole biosynthetic pathway of a Streptomyces antibiotic and its expression in a heterologous host, Nature, 1984, 309, 462-64.*
Takahashi et al., Reveromycin A biosynthesis uses RevG and RevJ for stereospecific spiroacetal formation, Nature Chem. Biol., Jun. 2011, 7, Supplementary Information.*
Galm et al., *Chemistry & Biology*, 14(10): 1098-1104 (Oct. 2007).
Shimizu et al., *Organic Letters*, 2(14): 2153-2156 (Jul. 1, 2000).
Shimizu et al., *Bioorganic & Medicinal Chemistry Letters*, 12(23): 3363-3366 (Jan. 1, 2002).
Shimizu et al., *Organic Letters*, 7(25): 5573-5576 (Dec. 1, 2005).
Takahashi et al., *Nature Chemical Biology*, 7(7): 461-468 (Jun. 5, 2011).
Zanatta et al., *Organic Letters*, 6(6): 1041-1044 (Mar. 1, 2004).
European Patent Office, Extended European Search Report in European Patent Application No. 11821826.2 (Feb. 18, 2014).
International Bureau of WIPO, International Preliminary Report on Patentability in International Application No. PCT/JP2011/069660 (Mar. 21, 2013).
Takahashi et al., *Journal of Bacteriology*, 192(11): 2839-2851 (Jun. 2010).
Takahashi et al., *Seikagaku*, 1S14P-4 (Sep. 25, 2009).
Japanese Patent Office, International Search Report in International Patent Application No. PCT/JP2011/069660 (Dec. 6, 2011).

* cited by examiner

*Primary Examiner* — Rebecca Prouty
*Assistant Examiner* — Todd M Epstein
(74) *Attorney, Agent, or Firm* — Leydig, Voit & Mayer, Ltd.

(57) ABSTRACT

A bacterium belonging to the genus *Streptomyces* having an ability to produce reveromycin A or a synthetic intermediate thereof, the bacterium being modified so as to increase expression of revQ gene coding for the amino acid sequence of SEQ ID NO: 36 or an amino acid sequence having an identity of not less than 80% to SEQ ID NO: 36 as compared with a parent strain, thereby the above-mentioned production ability is increased as compared with the parent strain.

18 Claims, 19 Drawing Sheets

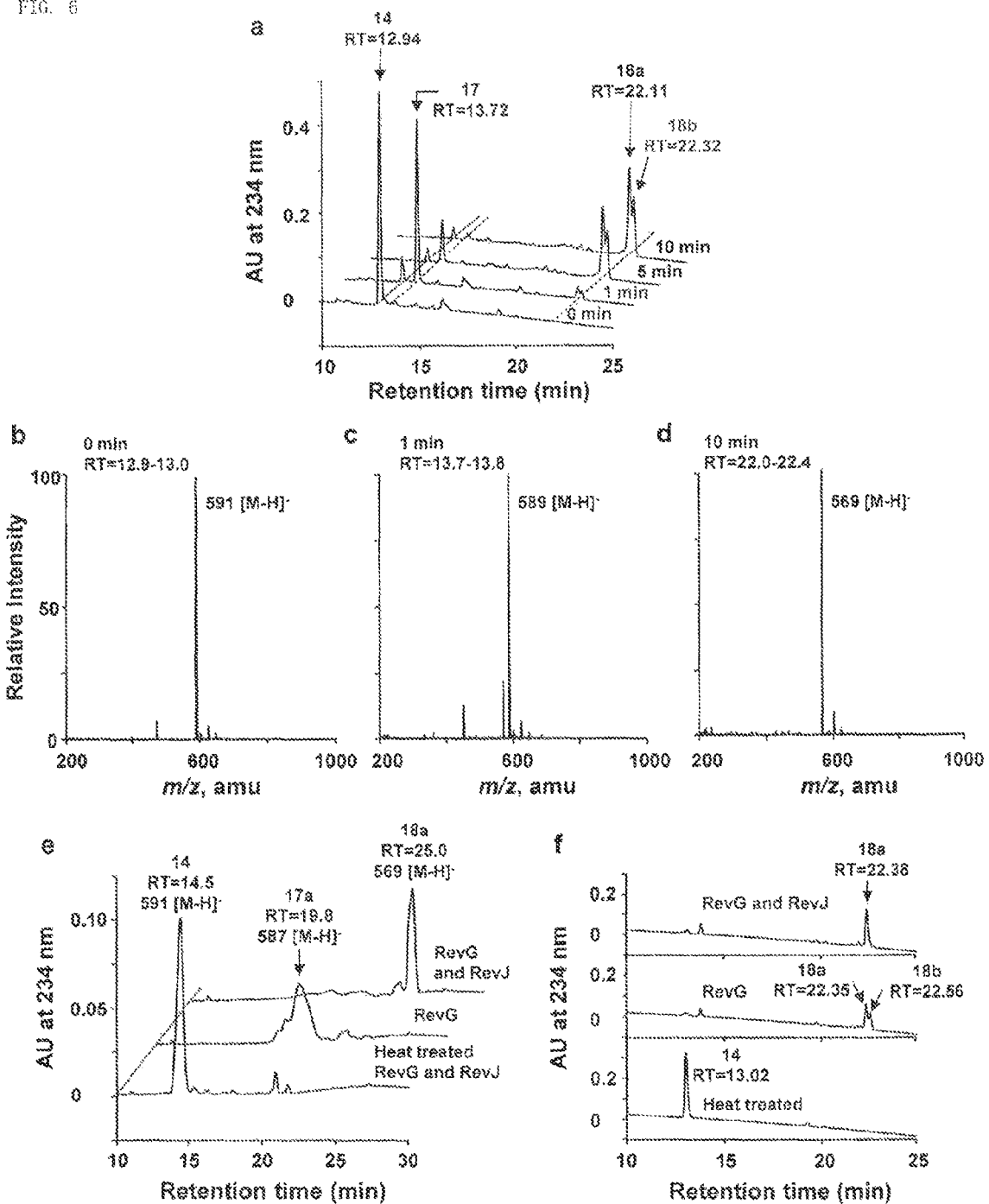

(A)

(B)

(A)

(B)

(A)

(B)

PROCESS FOR PRODUCING REVEROMYCIN A OR A SYNTHETIC INTERMEDIATE THEREOF, PROCESS FOR PRODUCING COMPOUNDS CONTAINING A SPIROKETAL RING AND NOVEL ANTINEOPLASTICS, FUNGICIDES AND THERAPEUTIC AGENTS FOR BONE DISORDERS

CROSS-REFERENCE TO RELATED APPLICATIONS

This patent application is the U.S. national phase of International Patent Application No. PCT/JP2011/069660, filed Aug. 30, 2011, which claims the benefit of Japanese Patent Application No. 2010-194222, filed Aug. 31, 2010, which are incorporated by reference in their entireties herein.

INCORPORATION-BY-REFERENCE OF MATERIAL ELECTRONICALLY SUBMITTED

Incorporated by reference in its entirety herein is a computer-readable nucleotide/amino acid sequence listing submitted concurrently herewith and identified as follows: 706,958 bytes ASCII (Text) file named "712170SequenceListing.txt," created Feb. 27, 2013.

TECHNICAL FIELD

The present invention relates to a method of producing a novel bacterium producing reveromycin A or synthetic intermediate thereof utilizing genetic recombination, a method of producing reveromycin A or synthetic intermediate thereof using the bacterium, and a method of producing spiroketal ring-containing compounds. The present invention also relates to a novel anticancer agent, antifungal agent and therapeutic agent for bone diseases.

BACKGROUND ART

Reveromycin A (RM-A) has been known to induce apoptosis selectively for osteoclasts at low concentrations and suppress bone metastasis of tumors (Patent Document 1). RM-A is a polyketide compound having spiroketal rings. Although a chemical synthesis technique has been established, multiple stages of synthesis steps are required. It is also produced through fermentation by a bacterium belonging to the genus Streptomyces (Streptomyces sp. SN-593) (Patent Document 2) but large scale production has been difficult. Because no genes involved in reveromycin biosynthesis have been reported, breeding of reveromycin-producing bacteria by genetic recombination has not been carried out.

PRIOR ART REFERENCES

Patent Documents

Patent Document 1: Japanese Patent Application Laid-Open Publication No. 07-223945
Patent Document 2: Japanese Patent Application Laid-Open Publication No. 04-49296

SUMMARY OF THE INVENTION

An object of the present invention is to create a microorganism capable of producing reveromycin A and synthetic intermediate thereof efficiently by genetic recombination.

Also, an object of the present invention is to provide a method of efficiently obtaining spiroketal ring-containing compounds. Further, an object of the present invention is to provide a novel anticancer agent, antifungal agent and therapeutic agent for bone diseases.

In order to solve the above-mentioned objects, the present inventors intensively studied. As a result, they have successfully identified a reveromycin biosynthesis gene cluster and found that a bacterium belonging to the Streptomyces in which one of the genes in the cluster, revQ gene is highly expressed produces reveromycin A and synthetic intermediates thereof efficiently. They have also found that revG and revJ gene products catalyze a reaction of generating spiroketal rings and spiroketal ring-containing compounds can be produced efficiently by using the gene products. Furthermore, they have found that compounds represented by the general formula (III) and (IV) shown below have efficacy as anticancer agents, antifungal agents and therapeutic agents for bone diseases. Based on the above findings, the present invention has been completed.

The present invention provides the followings.

[1] A bacterium belonging to the genus Streptomyces having an ability to produce reveromycin A or a synthetic intermediate thereof, wherein said bacterium has been modified so as to increase expression of revQ gene coding for the amino acid sequence of SEQ ID NO: 36 or an amino acid sequence having an identity of not less than 80% to SEQ ID NO: 36 as compared with a parent strain, thereby said production ability is increased as compared with the parent strain.

[2] The bacterium according to [1], wherein expression of revQ gene has been increased by enhancing the copy number of revQ gene or by modifying a promoter of revQ gene.

[3] The bacterium according to [1] or [2] wherein said bacterium has been obtained by modifying Streptomyces sp. SN-593 strain such that expression of revQ gene increases.

[4] A method of producing reveromycin A or a synthetic intermediate thereof comprising the steps of: culturing the bacterium belonging to the genus Streptomyces according to any one of [1] to [3] in a medium to accumulate reveromycin A or the synthetic intermediate thereof in the medium, and collecting reveromycin A or the synthetic intermediate thereof from the culture.

[5] A polynucleotide coding for the amino acid sequence of SEQ ID NO: 36 or an amino acid sequence having an identity of not less than 80% to SEQ ID NO: 36 and, when introduced in a bacterium belonging to the genus Streptomyces having an ability to produce reveromycin A or a synthetic intermediate thereof, said polynucleotide improves the production ability.

[6] A polynucleotide which is able to hybridize with a nucleotide sequence from 121 to 951 of SEQ ID NO: 35 under stringent conditions and, when introduced into a bacterium belonging to the genus Streptomyces having an ability to produce reveromycin A or a synthetic intermediate thereof, said polynucleotide improves the production ability.

[7] A method of producing compound (II) comprising the step of converting compound (I) into the compound (II) by reacting RevG protein having the amino acid sequence of SEQ ID NO: 14 or an amino acid sequence having an identity of not less than 80% to SEQ ID NO: 14 with the compound (I):

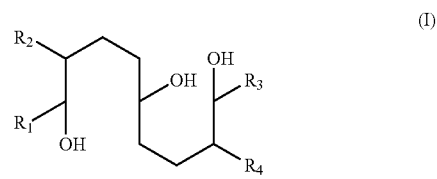
(I)

-continued

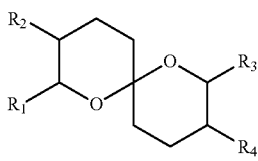
(II)

wherein R₁ and R₃ are hydrogen or a saturated or unsaturated aliphatic hydrocarbon group with 1 to 25 carbon atoms hydrogen atom of which may be substituted with a hydroxyl group, a carboxyl group, an oxo group, a phenyl group or pyridyl group, and two hydrogen atoms of which may form a ring with —O—; and R₂ and R₄ are an alkyl group with 1 to 10 carbon atoms.

[8] The method of producing the compound (II) according to [7] comprising reacting, in conjunction with said RevG protein, RevJ protein having the amino acid sequence of SEQ ID NO: 20 or an amino acid sequence having an identity of not less than 80% to SEQ ID NO: 20 with said compound (I).

[9] The method according to [7] or [8], wherein said compound (I) is a compound shown in the following (i); and said compound (II) is either one of compounds shown in the following (ii) or both.

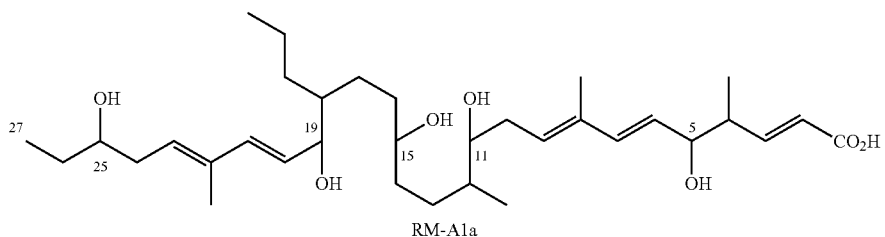
RM-A1a
(i)

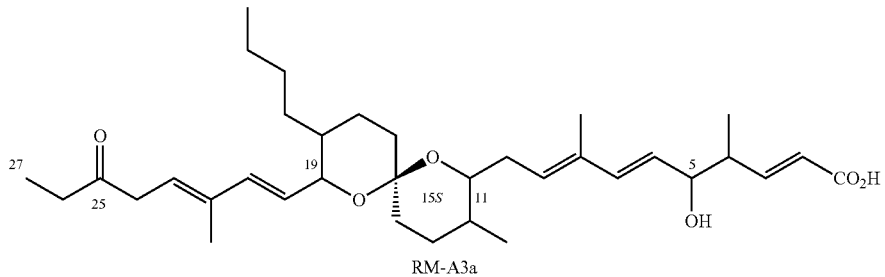
RM-A3a
(ii)

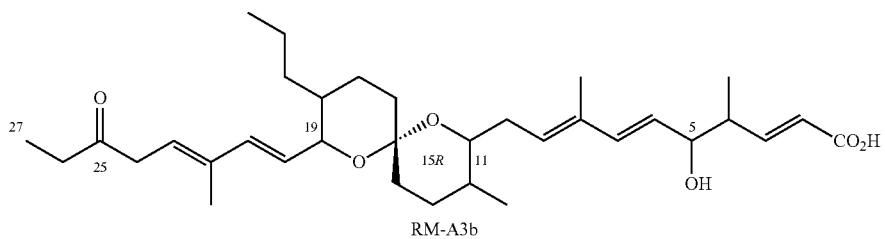
RM-A3b

[10] A protein having the amino acid sequence of SEQ ID NO: 14 or an amino acid sequence having an identity of not less than 80% to SEQ ID NO: 14, said protein having an activity to catalyze a reaction of converting the compound (I) into the compound (II).

[11] A polynucleotide coding for the protein according to [10].

[12] The polynucleotide according to [11] which is able to hybridize with a complementary strand of a nucleotide sequence from 121 to 939 of SEQ ID NO: 13 under stringent conditions.

[13] A polynucleotide coding for the amino acid sequence having an identity of not less than 80% to an amino acid sequence of SEQ ID NO: 2, 4, 6, 8, 10, 12, 16, 18, 20, 22, 24, 26, 28, 30, 34, 38, 40, 42 or 44, said polynucleotide coding for a reveromycin biosynthesis-related protein.

[14] An anticancer agent comprising a compound represented by the following general formula (III) or (IV) or a pharmaceutically acceptable salt thereof as an active component:

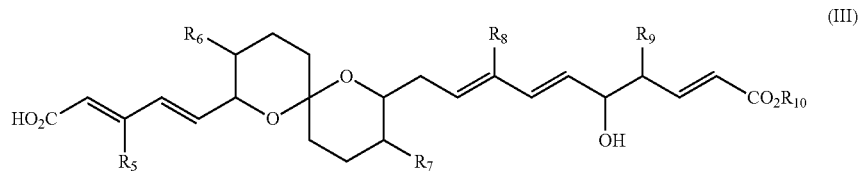

(III)

wherein $R_5$, $R_6$, $R_7$, $R_8$ and $R_9$ represent alkyl with 1 to 6 carbon atoms; and $R_{10}$ represents a hydrogen atom or alkyl with 1 to 5 carbon atoms:

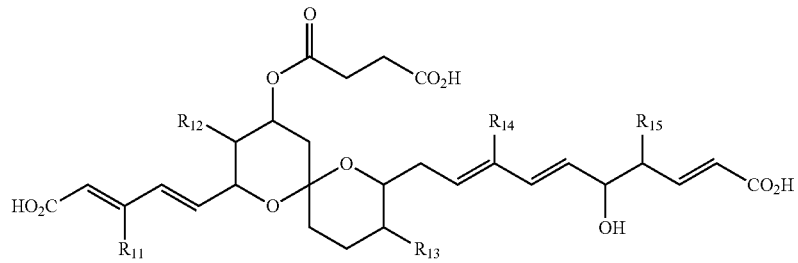

(IV)

wherein $R_{11}$, $R_{12}$, $R_{13}$, $R_{14}$ and $R_{15}$ represent alkyl with 1 to 6 carbon atoms.

[15] An antifungal agent comprising a compound represented by the following general formula (III) or a pharmaceutically acceptable salt thereof as an active component:

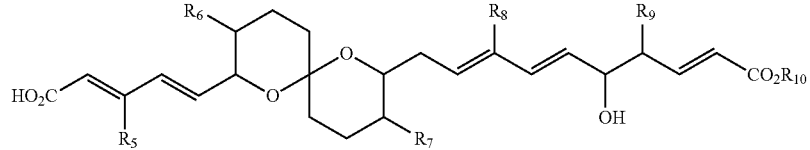

(III)

wherein $R_5$, $R_6$, $R_7$, $R_8$ and $R_9$ represent alkyl with 1 to 6 carbon atoms, and $R_{10}$ represents a hydrogen atom.

[16] A therapeutic agent for bone diseases comprising a compound represented by the following general formula (IV) or a pharmaceutically acceptable salt thereof as an active component:

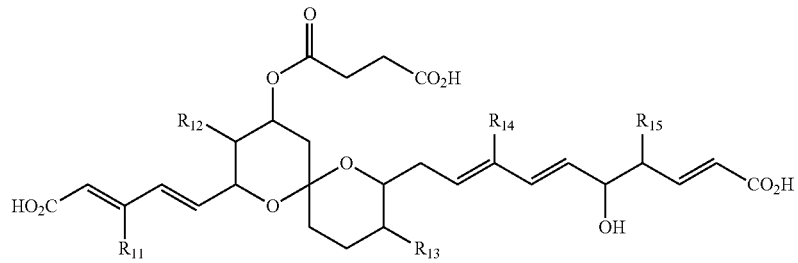

(IV)

wherein $R_{11}$, $R_{12}$, $R_{13}$, $R_{14}$ and $R_{15}$ represent alkyl with 1 to 6 carbon atoms.

According to the present invention, reveromycin A and synthetic intermediates thereof can be produced efficiently. Spiroketal ring-containing compounds can also be produced efficiently. Furthermore, novel anticancer agents, antifungal agents and therapeutic agents for bone diseases can be provided.

BRIEF DESCRIPTION OF THE DRAWINGS

FIG. 6 shows LC-MS analysis of RevG reaction products. (a) HPLC profiles after 0, 1, 5, and 10 minutes are shown. (b, c and d) Results of mass spectrometry are shown for a substrate from a sample at time 0 min (RM-A1a: (14) in FIG. 2), a products from a sample at time 1 min (RM-A2a: (17) in FIG. 2), a products from a sample at time 10 min (RM-A3a and A3b: (18a) and (18b) in FIG. 2). (e and f) LC-MS analysis when RM-A1a (14) was reacted with heat-treated RevG+RevJ. RevG alone, or RevG+RevJ in the absence (e) or presence (f) of formic acid.

FIG. 11-1 shows examples of compound that can serve as a substrate for RevG.

FIG. 11-2 shows examples of compound that can serve as a substrate for RevG.

FIG. 11-3 shows examples of compound that can serve as a substrate for RevG.

FIG. 11-4 shows examples of compound that can serve as a substrate for RevG.

FIG. 11-5 shows examples of compound that can serve as a substrate for RevG.

FIG. 11-6 shows examples of compound that can serve as a substrate for RevG.

EMBODIMENTS FOR CARRYING OUT THE INVENTION

Embodiments for carrying out the present invention will be described in detail below.

<1> Bacterium of the Present Invention and Method of Producing Reveromycin a or Synthetic Intermediates Thereof Using the Bacterium A bacterium of the present invention is a bacterium belonging to the *Streptomyces* having an ability to produce reveromycin A or synthetic intermediates thereof, which bacterium has been modified such that expression of revQ gene having the amino acid sequence of SEQ ID NO: 36 or an amino acid sequence having an identity of not less than 80% to SEQ ID NO: 36 is increased as compared with a parent strain, thereby the above-mentioned production ability is improved as compared with the parent strain.

Figure 2:
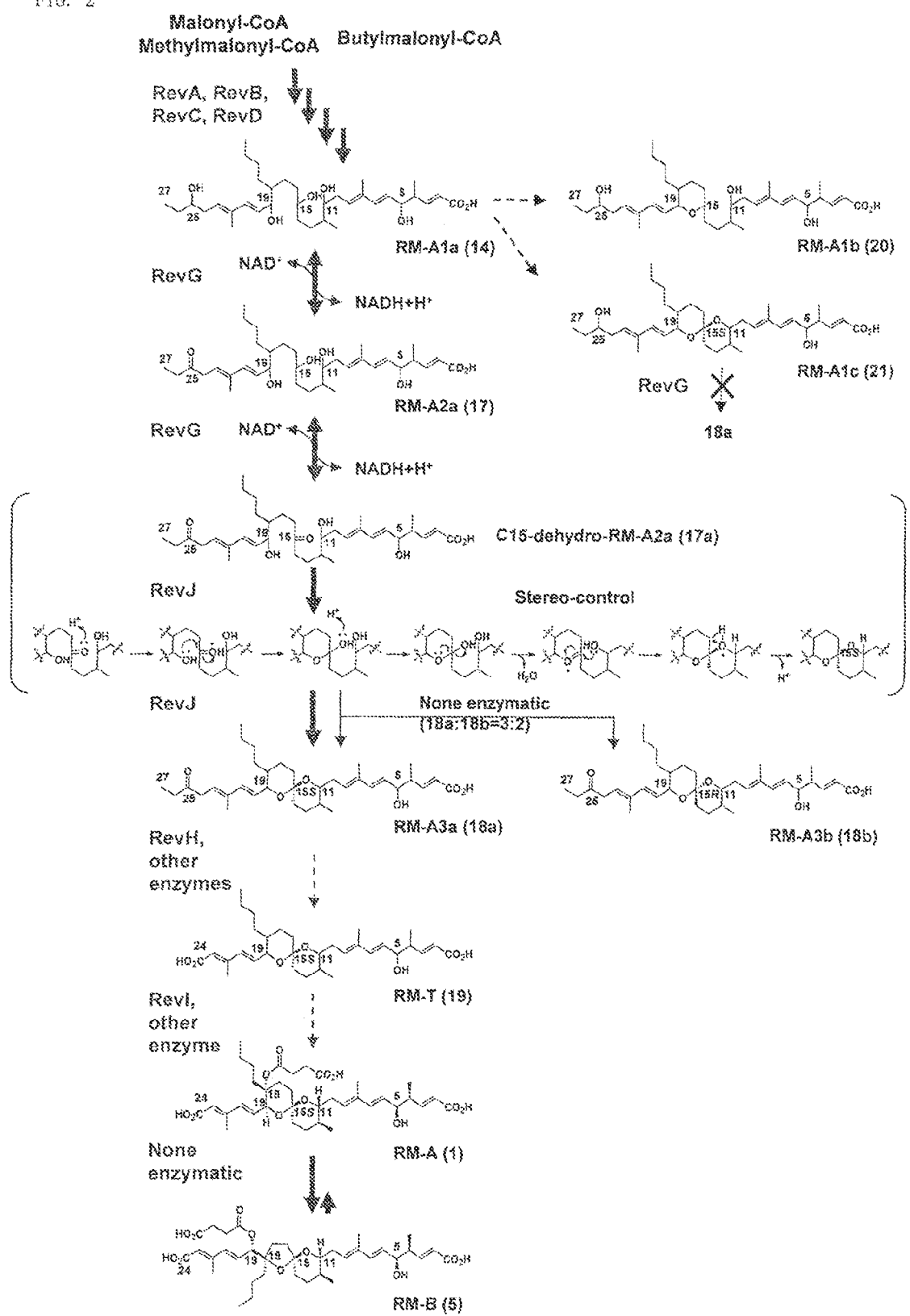
FIG. 2 shows the reveromycin A biosynthetic pathway.

A biosynthetic pathway of reveromycin A uncovered in the present invention is shown in FIG. 2, and examples of reveromycin A synthetic intermediates include RM-A1a, RM-A2a, RM-A3a, RM-A3b, RM-T, and the like.

revQ gene is a polynucleotide, and when it is introduced into a bacterium belonging to the *Streptomyces* such as *Streptomyces* sp. SN-593 strain having an ability to produce reveromycin A or synthetic intermediates thereof, the production ability is improved. The gene is not particularly restricted and examples thereof include a gene derived from *Streptomyces* sp. SN-593 strain having the nucleotide sequence from 121 to 951 of SEQ ID NO: 35. Further, revQ gene may be a DNA hybridizing with a sequence complementary to the above nucleotide sequence under stringent conditions as long as it is a gene improving the production ability of reveromycin A or synthetic intermediates thereof. Here, examples of the stringent conditions include a condition where hybridization is carried out at 60° C. at salt concentrations corresponding to 1×SSC, 0.1% SDS, preferably 0.1×SSC, 0.1% SDS, which is a common washing condition in Southern hybridization.

revQ gene may also be a gene coding for an amino acid sequence having an identity of not less than 80%, preferably not less than 90%, more preferably not less than 95%, particularly preferably not less than 99% to the amino acid sequence of SEQ ID NO: 36 and improving the production ability of reveromycin A or synthetic intermediate thereof.

Further, revQ gene may be a gene having the same amino acid sequence as an amino acid sequence of SEQ ID NO: 36 except that one or several amino acids are substituted, deleted, inserted, or added, and improving the production ability of reveromycin A or synthetic intermediate thereof. The term "one or several" here means preferably 1 to 20, more preferably 1 to 10, and particularly preferably 1 to 5.

Furthermore, revQ gene derived from a bacterium belonging to the *Streptomyces* other than *Streptomyces* sp. SN-593 strain or other microorganisms can be used. As these revQ genes, genes improving the production ability of reveromycin A or synthetic intermediates thereof which can be isolated based on homology from the chromosome of microorganisms, plants and animals or the like and whose nucleotide sequence is determined can be used. In addition, once the nucleotide sequence is determined, genes synthesized according to the sequence can be used. These can be obtained by amplifying a region containing an ORF segment by a hybridization method or PCR method.

The phrase "modified so as to increase expression of revQ gene as compared with a parent strain" means that expression level of revQ gene is enhanced preferably not less than 1.5 fold, and more preferably not less than two fold per unit bacterial cell weight, as compared with a parent strain (a strain before modification) such as *Streptomyces* sp. SN-593 strain. The expression level of genes can be determined by RT-PCR or Northern blotting method.

*Streptomyces* sp. SN-593 strain was deposited, as of Jun. 5, 1990, at Agency of Industrial Science and Technology, Fermentation Research Institute (current name, International Patent Organism Depositary, National Institute of Advanced Industrial Science and Technology, AIST, address Tsukuba Central 6, 1-1-3 Higashi, Tsukuba, Ibaraki, Japan, zip code 305-8566) under deposit No. FERM P-11503 and then has been transferred to international deposit under deposit No. FERM BP-3406 (Japanese Patent Application Laid-Open Publication No. 05-051303).

Besides *Streptomyces* sp. SN-593 strain, bacteria to be used in the present invention can be obtained by using bacteria exemplified below, as a parent strain and modifying the parent strain so as to increase expression of revQ gene.

*Streptomyces prunicolor*
*Streptomyces cinnamoneus*
*Streptomyces chromofuscus*
*Streptomyces lividans*
*Streptomyces akiyoshiensis*
*Streptomyces azureus*
*Streptomyces hawaiiensis*
*Streptomyces tendae*
*Streptomyces virginiae*
*Streptomyces amakusaensis*
*Streptomyces antibioticus*
*Streptomyces chibaensis*
*Streptomyces albus*
*Streptomyces lincolnensis*
*Streptomyces kanamyceticus*
*Streptomyces kasugaensis*
*Streptomyces coelicolor*
*Streptomyces griseus*
*Streptomyces avermitilis*
*Streptomyces ambofaciens*
*Streptomyces fradiae*

The above bacteria belonging to the genus *Streptomyces* are listed in an IFO catalog, ATCC catalog, JCM catalog or the like and those skilled in the art are readily able to obtain those.

The above bacteria to be used as parent strains in the present invention may be, in addition to a wild type strain, any strain including a mutant strain obtained by common mutagenic treatment such as UV irradiation, NTG treatment or the like, a recombinant strain induced by genetic techniques such as cell fusion, genetic recombination method or the like.

Enhancement of expression of revQ gene can be carried out by a genetic recombination method, for example, by increasing the copy number of revQ gene or substituting a promoter of this gene.

To increase the copy number of revQ gene, for example, the above revQ gene may just be incorporated into a plasmid capable of functioning in a host microorganism and introduced in the host microorganism such that it can be expressed.

A plasmid vector into which revQ gene can be incorporated are not particularly restricted as long as it contains at least a gene controlling functions of replication and proliferation in a host bacterium. Examples of the above vector involved in autonomous replication include plasmid DNA, virus, bacteriophage, bacterial chromosome and the like.

Examples of the plasmid DNA include plasmids of *Escherichia coli* origin (ColE-based plasmid such as pBR322, pUC18, pUC19, pUC118, pUC119, pBluescript or the like). In addition, the following plasmids of actinomycetes origin can be used:

pIJ486 (Mol. Gen. Genet. 203, 468-478, 1986),
pKC1064 (Gene 103, 97-99 (1991)),
pUWL-KS (Gene 165, 149-150 (1995)),
pIJ702 (J. Gen. Microbiol. 129:2703-2714 (1983)),
pIJ8600 (Microbiology 145:2221-2227 (1999)).

Examples of phage DNA include λ phages (Charon4A, Charon21A, EMBL3, EMBL4, λgt10, λgt11) and the like.

Introduction of recombinant DNA into a host can be carried out by a known method. For instance, a method comprising preparing spheroplasts from bacteria belonging to the *Streptomyces* using lysozyme, and thereafter adding a recombinant DNA vector and buffer containing polyethylene glycol so that the cells take up the vector [Thompson, C. J., et al. (1982) J. Bacteriol., 151, 668-677 or Hopwood, D. A., et al. (1985) "Genetic Manipulation of *Streptomyces*: A Laboratory Manual", The John Innes Foundation, Norwich see/reference] is commonly used as a method of transforming bacteria belonging to the *Streptomyces*. It can also be carried out by an electric pulse method (Res. Microbiol., Vol. 144, p. 181-185, 1993).

Introduction of DNA may be confirmed using selection marker genes (for example, ampicillin-resistant gene, tetracycline-resistant gene, chloramphenicol-resistant gene, kanamycin-resistant gene or the like).

Further, enhancement of expression of revQ gene can be carried out by making multiple copies of revQ gene on the chromosome by a known homologous recombination method.

Enhancement of expression of revQ gene can also be carried out by substituting or modifying a promoter of revQ gene on the host chromosome. Examples of a method of substituting a promoter include a known homologous recombination method and a method using sacB gene (Schafer, A. et al. Gene 145 (1994) 69-73).

In the introduction or homologous recombination on the chromosome by the above recombinant plasmid, a promoter for expressing revQ gene or a promoter used for substituting a promoter of revQ gene on the chromosome is not particularly restricted as long as it can function in host bacteria; and examples thereof include the followings.

tipA promoter which induces transcription by addition of antibiotic, thiostrepton (Gene 94:53-59, 1990; Gene 103:97-99, 1991; Gene 166:133-137, 1995), glyCAB promoter which is induced with glycerol (Mol. Microbiol. 12: 737-745, 1994) and mcrAB promoter which is induced with mitomycin C (Gene 175:261-267, 1996) can be used in an expression vector.

Examples thereof also include lac promoter, tac promoter, trc promoter and the like, which are used for *Escherichia coli*.

When it comes to methods of, in addition to excision and ligation of DNA, preparation of chromosome DNA, PCR, preparation of plasmid DNA, transformation, setup of oligonucleotides used as primers, and the like, common methods that are well known to those skilled in the art can be employed. These methods are described in Sambrook, J., Fritsch, E. F., and Maniatis, T., "Molecular Cloning A Laboratory Manual, Second Edition", Cold Spring Harbor Laboratory Press, (1989) or the like.

By inoculating the above bacteria into a nutrient source-containing medium and culturing aerobically, reveromycin A and synthetic intermediate thereof are produced.

Any medium can be used for culturing as long as it is a medium containing nutrient sources which bacteria belonging to the *Streptomyces* are able to utilize, and any of various synthesis media, semi-synthetic media, natural media or the like can be used. As for medium composition, glucose, sucrose, fructose, glycerin, dextrin, starch, molasses, corn steep liquor, organic acid, and the like may be used solely or in combination as carbon sources. As nitrogen sources, organic nitrogen sources such as Pharmamedia, peptone, meat extract, yeast extract, soy flour, casein, amino acid, urea or the like, or inorganic nitrogen sources such as sodium nitrate, ammonium sulfate or the like may be used solely or in combination.

Sodium salts, potassium salts, magnesium salts, phosphate, other heavy metal salts or the like may be added to be used as necessary. When significant foaming is observed during culturing, various known antifoaming agents such as ADEKA NOL (registered trademark), silicone oil or the like can be added in a medium as appropriate, but the addition should not give any adverse effects on production of intended substances. For instance, the agent is preferably used at not more than 0.5%.

The pH of a medium is desirably in an optimum pH range for microorganisms, which is usually around neutral pH. The temperature of a medium should probably be maintained at temperature at which microorganisms grow well, which is usually 20 to 40° C., particularly preferably around 27° C. The period of culturing is generally about for 1 to 5 days and preferably for about 72 hours in the case of liquid culture. By the above culturing, reveromycin A and synthetic intermediate thereof are generated and accumulated. As a matter of course, various culture conditions stated above can be appropriately altered according to the type and characteristics of microorganism used, external conditions or the like, and an optimum condition is selected from the above range and adjusted according to each.

Isolation of reveromycin A or synthetic intermediates thereof produced by the above culture can be carried out by any of means using differences in solubility between reveromycin A or synthetic intermediates thereof and impurities, means using differences in adsorption affinity, and means using differences in molecular weight. Each of the methods is used solely or appropriately in combination, or is repeatedly used.

Specifically, because a majority of reveromycin A is present in a culture filtrate, the culture filtrate is subjected to purification using various gel filtration chromatography, adsorption chromatography, liquid chromatography and the like in combination to obtain a fraction containing reveromycin A and other active components. Powder obtained by lyophilizing this fraction is further purified by developing, for example, in a system with 18% methanol:0.01% ammonia using high performance liquid chromatography (for example, Capcell Pak column), thereby yielding reveromycin A as purified white powder (Japanese Patent Application Laid-Open Publication No. 05-051303). Other reveromycin A synthetic intermediates can be obtained by method described in Examples.

<2> Method of Producing Spiroketal Ring-Containing Compounds

The present invention also provides a method of producing the compound (II) comprising the step of converting the compound (I) into the compound (II) by reacting RevG protein having the amino acid sequence of SEQ ID NO: 14 or an amino acid sequence having an identity of not less than 80% to SEQ ID NO: 14 with the compound (I):

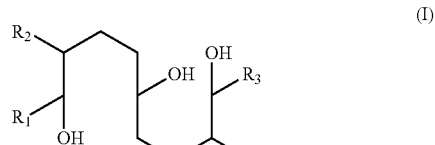

(I)

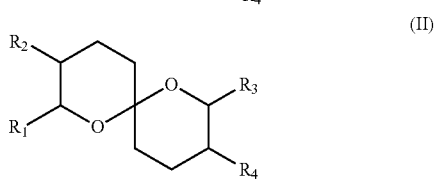

(II)

wherein $R_1$ and $R_3$ are hydrogen, or a saturation or unsaturated aliphatic hydrocarbon group with 1 to 25 carbon atoms (preferably 1 to 10) hydrogen atom of which may be substituted with a hydroxyl group, a carboxyl group, an oxo group, a phenyl group or pyridyl group, and two hydrogen atoms of which may form a ring with —O—; and $R_2$ and $R_4$ are an alkyl group with 1 to 10 carbon atoms, and preferably an alkyl group with 1 to 6 carbon atoms.

The compound (I) is preferably a compound represented by the following (i) while the compound (II) is preferably a compound represented by the following (ii).

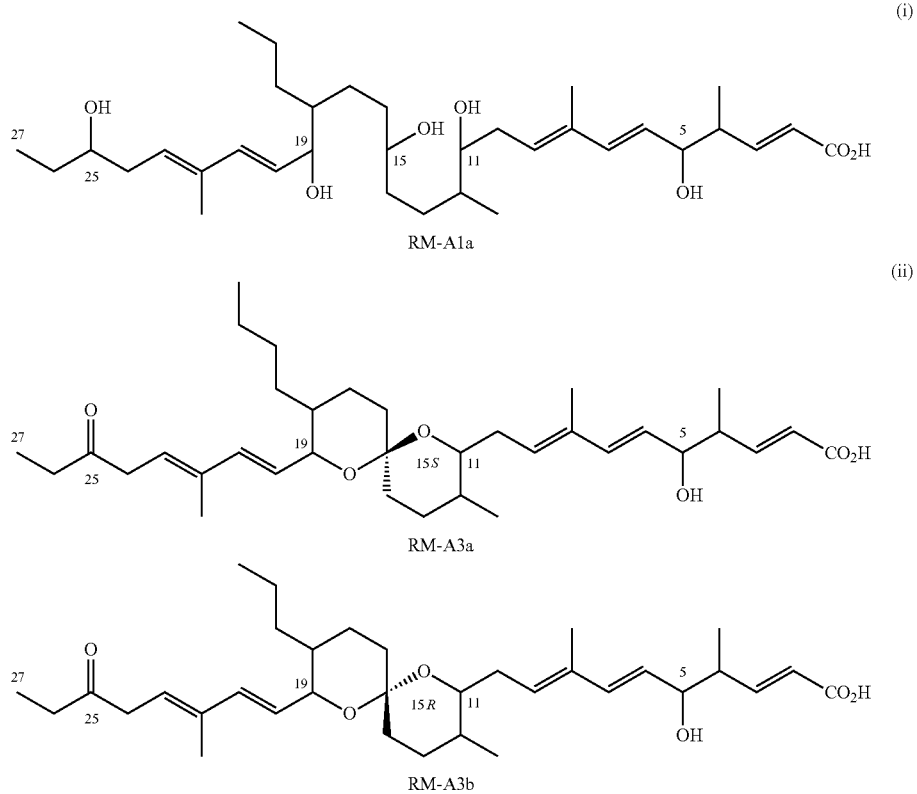

Figures 1, 11:
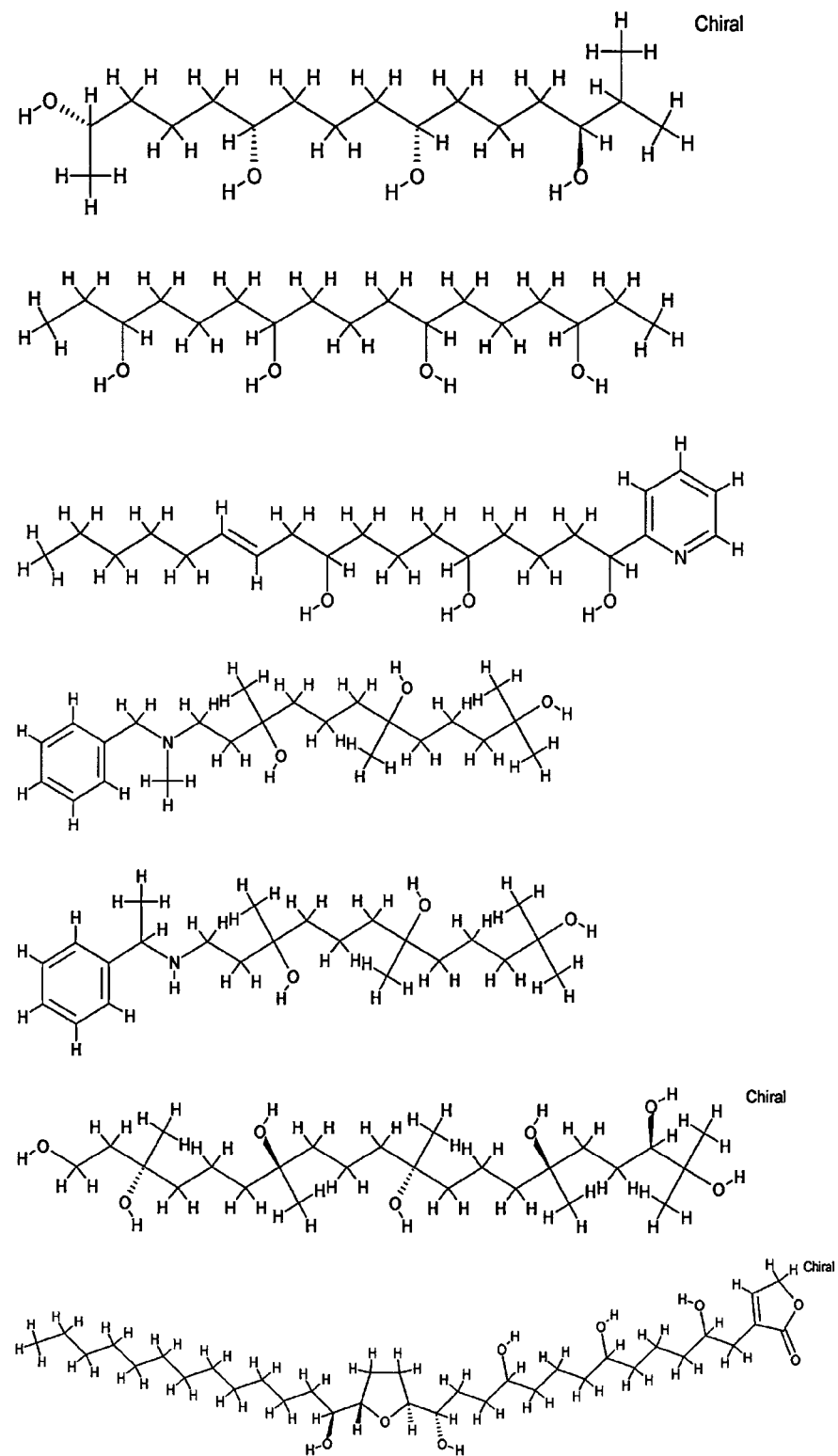
Figures 2, 11:
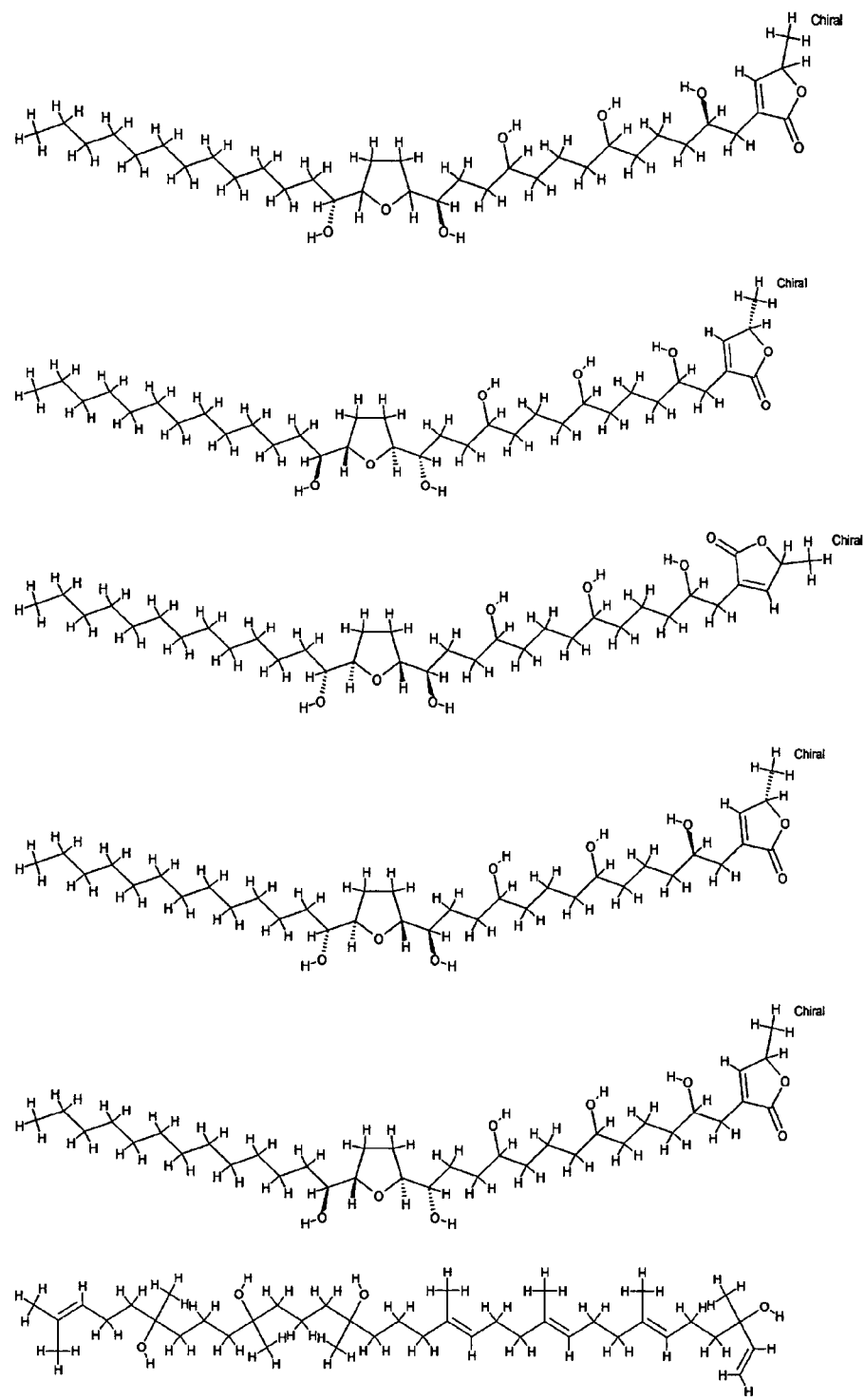
Figures 3, 11:
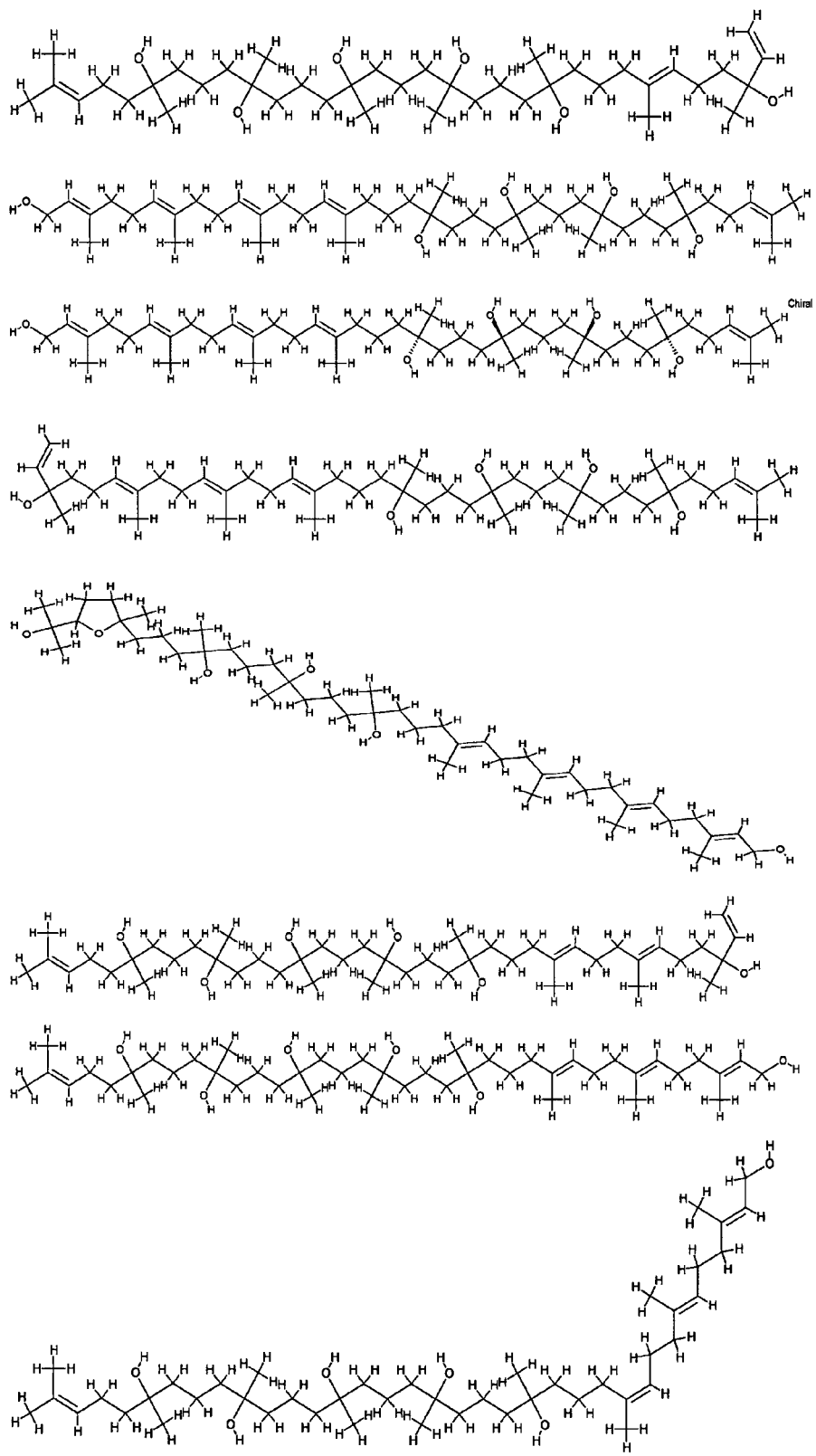
Figures 4, 11:
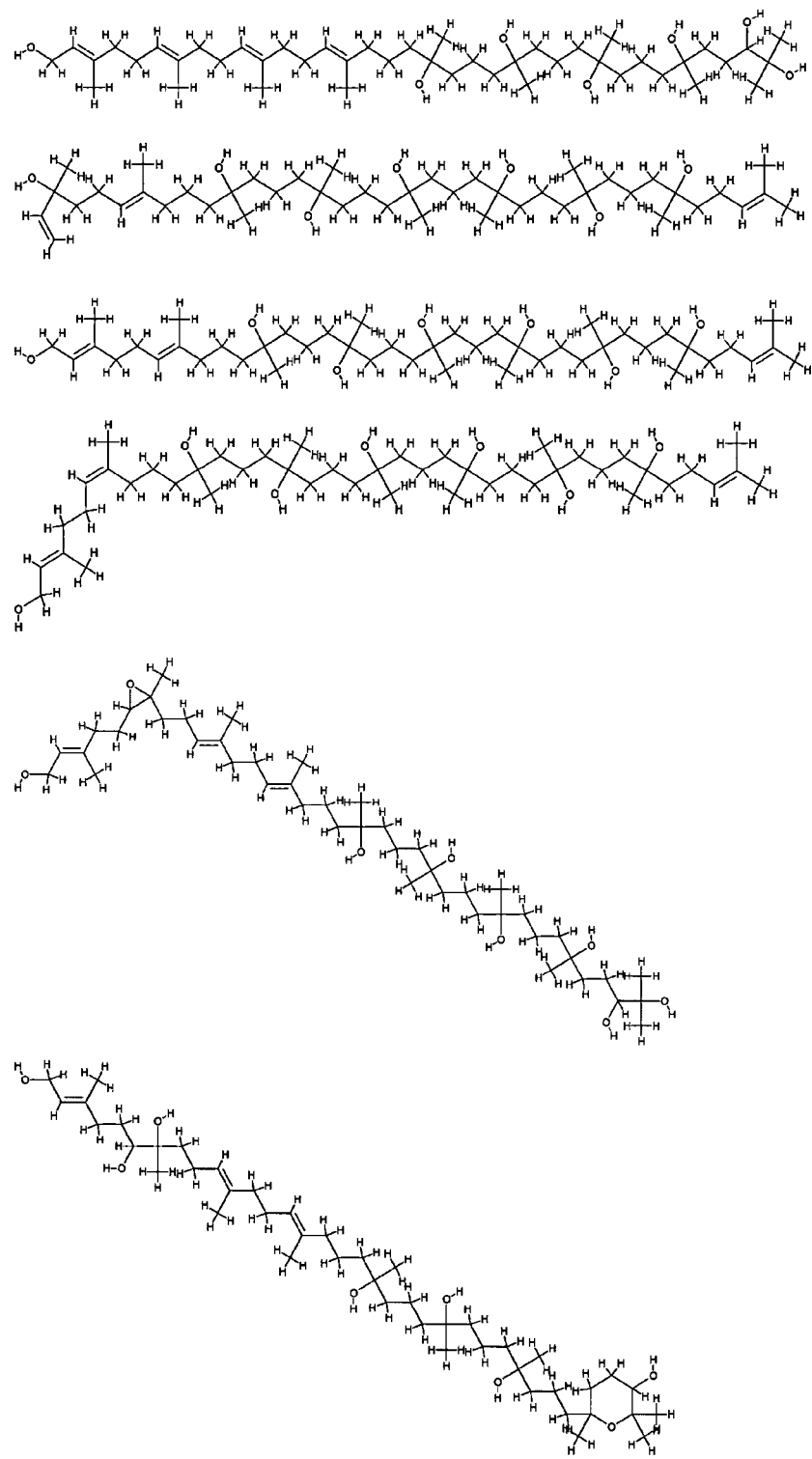
Figures 5, 11:
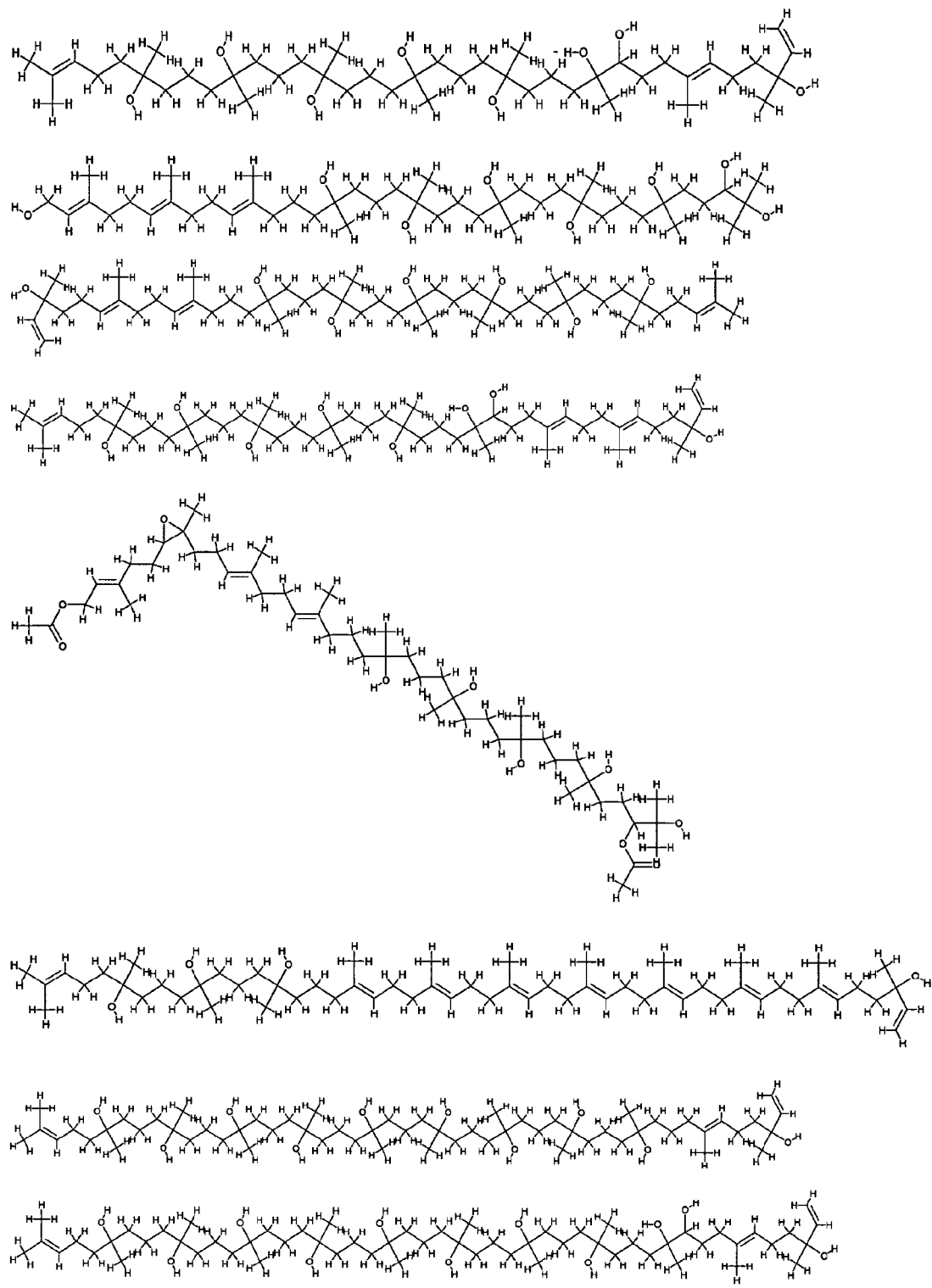

Further, examples of the compound (I) include a compound described in FIG. 11.

In conjunction with RevG protein, RevJ protein may be reacted with the compound (I).

Examples of RevG protein include a protein derived from *Streptomyces* sp. SN-593 strain having the amino acid sequence of SEQ ID NO: 16, and may be a protein having an identity of not less than 80%, preferably not less than 90%, more preferably not less than 95%, particularly preferably not less than 99% to the amino acid sequence of SEQ ID NO: 16, and having an activity of catalyzing a reaction converting the compound (I) into the compound (II).

Further, RevG protein may be a protein having the same amino acid sequence as the amino acid sequence of SEQ ID NO: 16 except that one or several amino acids are substituted, deleted, inserted or added, and having an activity of catalyzing a reaction converting the compound (I) into the compound (II). The term "one or several" here means preferably 1 to 20, more preferably 1 to 10, and particularly preferably 1 to 5.

Examples of RevJ protein include a protein derived from *Streptomyces* sp. SN-593 strain having the amino acid sequence of SEQ ID NO: 20, and may be a protein having an identity of not less than 80%, preferably not less than 90%, more preferably not less than 95%, particularly preferably not less than 99% to the amino acid sequence of SEQ ID NO: 20, and having an activity of catalyzing a reaction converting the compound (I) into the compound (II) in conjunction with RevG.

Further, RevJ protein may be a protein having the same amino acid sequence as the amino acid sequence of SEQ ID NO: 20 except that one or several amino acids are substituted, deleted, inserted or added, and having an activity of catalyzing a reaction converting the compound (I) into the compound (II) in conjunction with RevG. The term "one or several" here means the same as the above.

RevG protein and RevJ protein can be obtained by purification from a bacterium belonging to the *Streptomyces* such as *Streptomyces* sp. SN-593 strain or the like. revG gene and RevJ protein can be expressed in an appropriate host (a bacterium belonging to the *Streptomyces*, a bacterium belonging to the genus *Escherichia*, yeast or the like) or in a cell-free system, followed by purification to obtain RevG protein and RevJ protein. On that occasion, it is preferred, for simple and convenient purification, that the proteins be fused with a tag such as poly histidines, GST or the like and expressed, followed by purification making use of affinity for the tag.

revG gene that can be used in this case is not particularly limited as long as it codes for a protein having an activity of catalyzing a reaction converting the compound (I) into the compound (II), and examples thereof include a gene derived from *Streptomyces* sp. SN-593 strain having the nucleotide sequence from 121 to 939 of SEQ ID NO: 13. revJ gene is not particularly limited as long as it code for a protein having an activity of catalyzing a reaction converting the compound (I)

into the compound (II) in conjunction with RevG, and examples thereof include a gene derived from *Streptomyces* sp. SN-593 strain having the nucleotide sequence from 121 to 1128 of SEQ ID NO: 19. In addition, as long as revG gene and revJ gene are ones coding for a proteins having an activity of catalyzing a reaction converting the compound (I) into the compound (II), they may be DNA that is able to hybridize with DNA having a sequence complementary to the above nucleotide sequence under stringent conditions. Here, examples of the stringent conditions include a condition where hybridization is carried out at 60° C. at salt concentrations corresponding to 1×SSC, 0.1% SDS, preferably 0.1× SSC, 0.1% SDS, which is a common washing condition in Southern hybridization.

A fraction, crude purified fraction or bacterium itself containing RevG protein and RevJ protein may be used.

For a reaction of RevG protein, or RevG protein and RevJ protein, with a compound of (I), both may just be mixed in a solution. A reaction temperature is a temperature suitable for an enzymatic reaction and is preferably 20 to 40° C.

<3> Novel Polynucleotide

The present invention further provides, in addition to the above revG gene and revQ gene, each of the following novel polynucleotides.

revC gene: SEQ ID NO: 1 (The coded amino acid sequence is SEQ ID NO: 2)
revA gene: SEQ ID NO: 3 (The coded amino acid sequence is SEQ ID NO: 4)
revB gene: SEQ ID NO: 5 (The coded amino acid sequence is SEQ ID NO: 6)
revD gene: SEQ ID NO: 7 (The coded amino acid sequence is SEQ ID NO: 8)
revE gene: 121 to 1221 of SEQ ID NO: 9 (The coded amino acid sequence is SEQ ID NO: 10)
revF gene: 121 to 1569 of SEQ ID NO: 11 (The coded amino acid sequence is SEQ ID NO: 12)
revH gene: 121 to 1641 of SEQ ID NO: 15 (The coded amino acid sequence is SEQ ID NO: 16)
revH gene: 121 to 1311 of SEQ ID NO: 17 (The coded amino acid sequence is SEQ ID NO: 18)
revJ gene: 121 to 1128 of SEQ ID NO: 19 (The coded amino acid sequence is SEQ ID NO: 20)
revK gene: 121 to 1050 of SEQ ID NO: 21 (The coded amino acid sequence is SEQ ID NO: 22)
revL gene: 121 to 1191 of SEQ ID NO: 23 (The coded amino acid sequence is SEQ ID NO: 24)
revM gene: 121 to 1080 of SEQ ID NO: 25 (The coded amino acid sequence is SEQ ID NO: 26)
revN gene: 121 to 1035 of SEQ ID NO: 27 (The coded amino acid sequence is SEQ ID NO: 28)
revO gene: 121 to 777 of SEQ ID NO: 29 (The coded amino acid sequence is SEQ ID NO: 30)
revP gene: 121 to 792 of SEQ ID NO: 33 (The coded amino acid sequence is SEQ ID NO: 34)
revR gene: 121 to 1119 of SEQ ID NO: 37 (The coded amino acid sequence is SEQ ID NO: 38)
revS gene: 121 to 1857 of SEQ ID NO: 39 (The coded amino acid sequence is SEQ ID NO: 40)
revT gene: 121 to 1449 of SEQ ID NO: 41 (The coded amino acid sequence is SEQ ID NO: 42)
revU gene: 121 to 2889 of SEQ ID NO: 43 (The coded amino acid sequence is SEQ ID NO: 44)

Further, as long as each of the above genes codes for a protein having an activity involved in reveromycin biosynthesis shown in the Examples, it may be DNA hybridizing with a complementary strand of each nucleotide sequence under stringent conditions.

In addition, as long as each of the above genes codes for a protein having an activity involved in reveromycin biosynthesis shown in the Examples, it may be a homolog, mutant or artificially modified one coding for the same amino acid sequence as each amino acid sequence except that one or several amino acids are substituted, deleted, inserted, added or the like at one or more positions. The term "one or several" here varied depending on the position of amino acid residues in a three-dimensional conformation of a protein and the type of amino acid residues, and specifically means 1 to 20, preferably 1 to 10, and more preferably 1 to 5.

Furthermore, as long as each of the above gene codes for a protein involved in reveromycin biosynthesis, it may be a gene coding for an amino acid sequence having an identity of not less than 80%, preferably not less than 90%, more preferably not less than 95%, particularly preferably not less than 97% to the whole of each amino acid sequence.

<4> Anticancer Agent

An anticancer agent of the present invention contains a compound represented by the following general formula (III) or (IV) or pharmaceutically acceptable salts thereof as an active component.

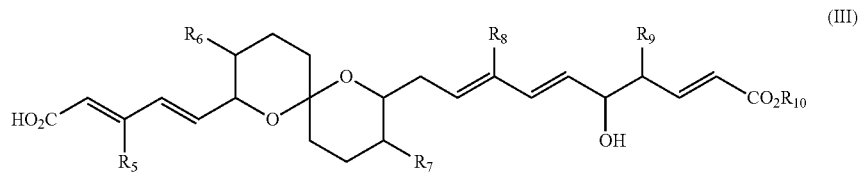

(III)

wherein $R_5$, $R_6$, $R_7$, $R_8$ and $R_9$ represent an alkyl with 1 to 6 carbon atoms, and $R_5$, $R_7$, $R_8$ and $R_9$ are preferably alkyl with 1 to 3 carbon atoms and more preferably methyl. $R_6$ is preferably alkyl with 3 to 6 carbon atoms and more preferably butyl.

$R_{10}$ represents a hydrogen atom or an alkyl with 1 to 5 carbon atoms, and preferably a hydrogen atom, methyl or ethyl.

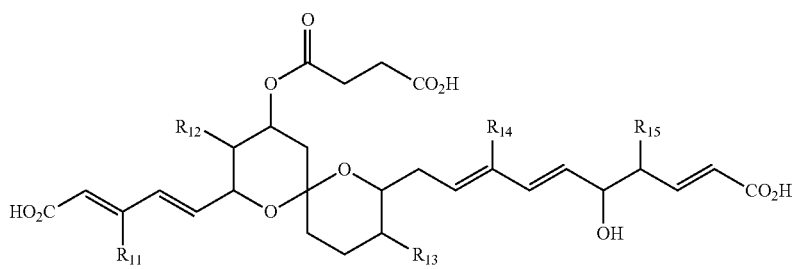

(IV)

wherein $R_{11}$, $R_{12}$, $R_{13}$, $R_{14}$ and $R_{15}$ represent an alkyl with 1 to 6 carbon atoms, and $R_{11}$, $R_{13}$, $R_{14}$ and $R_{15}$ are preferably alkyl with 1 to 3 carbon atoms and more preferably methyl. $R_{12}$ is preferably alkyl with 3 to 6 carbon atoms and more preferably butyl.

Examples of the pharmaceutically acceptable salt include mineral acid salt such as hydrochloride, sulfate or the like; organic acid salt such as toluenesulfonate or the like; metal salt such as sodium salt, potassium salt, calcium salt or the like; ammonium salt; organic ammonium salt such as methyl ammonium salt or the like; amino acid salt such as glycine salt or the like, but are not limited thereto. In the case of using as the following antifungal agent or therapeutic agent for bone diseases, the same is applied.

In the present specification, "anticancer agent" refers to one used for the purpose of killing and damaging cancer cells, suppressing cancer cell proliferation, preventing cancer metastasis, preventing cancer recurrence, taking preventive measures against cancer development or the like.

Concrete examples of cancer indicated for administration include malignant melanoma, malignant lymphoma, digestive organ cancer, lung cancer, esophageal cancer, stomach cancer, large bowel cancer, rectal cancer, colon cancer, ureteral tumor, gallbladder cancer, bile duct cancer, biliary tract cancer, breast cancer, liver cancer, pancreatic cancer, testicular tumor, maxillary cancer, tongue cancer, lip cancer, oral cancer, pharyngeal cancer, larynx cancer, ovarian cancer, uterine cancer, cervical cancer, prostate cancer, thyroid cancer, brain tumor, Kaposi sarcoma, hemangioma, leukemia, polycythemia vera, neuroblastoma, retinoblastoma, myeloma, bladder tumor, sarcoma, osteosarcoma, myosarcoma, skin cancer, basal cell carcinoma, skin appendage carcinoma, metastatic skin cancer, cutaneous melanoma and the like, but are not limited thereto.

When the above compound is administered to a patient, the dosage can be appropriately set according to age or body weight of a patient, the type of cancer and the stage of cancer progression, symptoms or the like. The dosage per adult per day is generally, in terms of active component, 0.1 to 1000 mg/kg of body weight, in particular 1 to 100 mg/kg of body weight, which can be administered once or in several divided doses. An administration route is not particularly restricted and, for example, oral administration or parenteral administration such as injection or the like can be employed for administration. In the case of administration by injection, the intravenous injection, intra-arterial injection, subcutaneous injection, intradermal injection, intraperitoneal injection, intramuscular administration or the like can be carried out.

An anticancer agent of the present invention can contain a carrier which is commonly used in a pharmaceutical composition in addition to a compound represented by the formula (III) or (IV) or a salt thereof which is contained as an active ingredient. Formulation thereof can be appropriately selected according to intended use or intended subject. For instance, a form of injections (solutions, suspension agents or the like), tablets, balls, powders, solutions, suspension agents, emulsions, granules, capsules or the like can be employed. Examples of the above carrier include an excipient, binder, disintegrator, emulsifier, solubilizing agent, dispersant, lubricant, coating agent, coloring agent, stabilizer, isotonic agent and the like but are not limited thereto. The excipient can be one which is generally used including, for example, saccharides such as lactose, white sugar, glucose or the like, starch, inorganic substance such as calcium carbonate, calcium sulfate or the like, crystalline cellulose, distilled water, purified water, sesame oil, soybean oil, corn oil, olive oil, cotton seed oil and the like. An agent of the present invention can be formulated using these additives by a conventional method. In addition, the anticancer agent of the present invention can be used in combination with other pharmaceutical products (for example, other anticancer agents or the like).

Further, a method of treating cancers comprising the step of administering a therapeutically effective amount of the compound represented by the formula (III) or (IV) or a pharmaceutically acceptable salt thereof to mammals including human is provided by the present invention.

<5> Antifungal Agent

An antifungal agent of the present invention contains compound represented by the following general formula (III) or a pharmaceutically acceptable salt thereof as an active component.

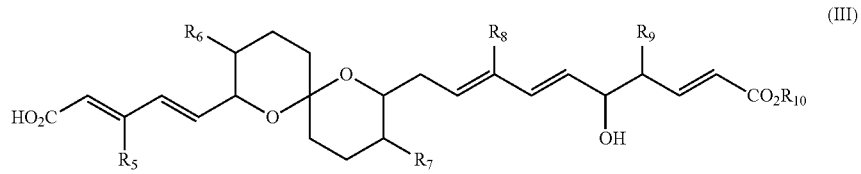

(III)

wherein $R_5$, $R_6$, $R_7$, $R_8$ and $R_9$ represent alkyl with 1 to 6 carbon atoms and $R_{10}$ represents a hydrogen atom. $R_5$, $R_7$, $R_8$ and $R_9$ are preferably alkyl with 1 to 3 carbon atoms and more preferably methyl. $R_6$ is preferably alkyl with 3 to 6 carbon atoms and more preferably butyl.

Antifungal agents broadly mean agents having fungicidal actions or growth inhibiting actions against fungi. Examples of fungi include, besides yeast and mushroom, so-called filamentous bacteria (mold), and antifungal agents are used against, in particular, fungi causing endogenous infection such as *Candida albicans, Candida pseudotropicalis* or the like. The antifungal agent of the present invention can be used, for example, in treatment of local fungus infection, mucosa infection, systemic fungus infection or the like from the genus *Candida*, the genus *Trichophyton* or the genus *Aspergillus* or the like. Further, a method of treating local fungus infection, mucosa infection, systemic fungus infection or the like, which method comprises the step of administering a therapeutically effective amount of a compound represented by the formula (III) or a pharmaceutically acceptable salt thereof to mammals including human, is provided by the present invention.

A method of measuring antifungal activities is not particularly restricted. For instance, the antifungal activities can be measured, using any one or more types of the above fungus as assay strains, by observing, as an index, the formation of a proliferation inhibition circle on a flat plate medium, by incubating the fungus in a liquid medium for an appropriated period and thereafter measuring turbidity of the medium, or the like.

A compound represented by the general formula (III) or a pharmaceutically acceptable salt thereof as an active component can be used as an antifungal agent as it is or in combination with various carriers commonly used in a pharmaceutical composition as mentioned above. Formulation thereof can be appropriately selected according to intended use or intended subject and, for instance, a form of skin external preparations such as creams or ointments or the like, tablets, balls, powders, solutions, suspension agents, emulsions, granules, capsules, suppositories, injections (solutions, suspension agents or the like) or the like can be used.

An antifungal agent of the present invention can be administered to mammals including human. An administration route may be oral administration or parenteral administration. The dosage of antifungal agent of the present invention should be appropriately increased or decreased according to conditions such as age, sex, or body weight of a patient, symptoms and administration routes. In general, the dosage for adult is, in terms of an amount of active component, in a range about from 1 μg/kg to 1000 mg/kg per day and preferably in an approximate range from 10 μg/kg to 100 mg/kg per day. The above dosage may be administered once a day or in several divided doses a day. A period for administration and interval of administration are also not particularly restricted and administration may be carried out daily or once in several days.

Further, an antifungal agent of the present invention can be combined with not only pharmaceutical products but also products taken in the inside of the body of human or animals or applied onto the body surface such as food products, feeds, cosmetics or the like, and any other products which are generally expected to prevent or suppress fungal growth. In addition, the antifungal agent of the present invention can be used in surface treatment for products or raw materials. Specifically, the agent may be added in, combined with, sprayed to, attached to, coated on, impregnated in food products, pharmaceutical products, quasi drugs, various cosmetics, various dental care products, various sanitary products, various baby goods, various products for the elderly, various cleanser, various supplies material for microorganism elimination, pet foods, various livestock samples, various feeds for farmed fish, various architectural materials, various paints, various products for agricultural and horticultural use and materials used as raw materials thereof, and any other products which are generally expected to prevent or suppress growth of microorganisms such as fungi or the like. In addition, it can be used for treatment any other products which are generally expected to prevent or suppress fungal growth.

<6> Therapeutic Agent for Bone Diseases

Therapeutic agent for bone diseases of the present invention contains a compound represented by the following general formula (IV) or a pharmaceutically acceptable salt thereof as an active component.

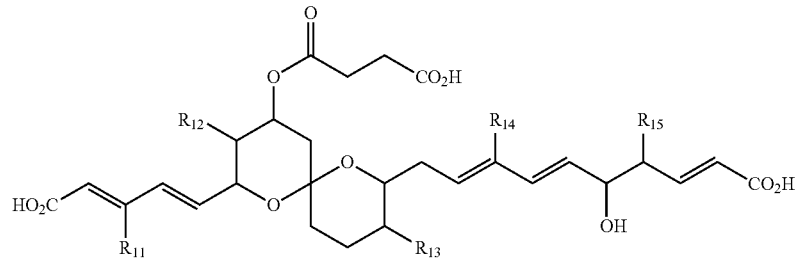

(IV)

wherein $R_{11}$, $R_{12}$, $R_{13}$, $R_{14}$ and $R_{15}$ represent alkyl with 1 to 6 carbon atoms. $R_{11}$, $R_{13}$, $R_{14}$ and $R_{15}$ are preferably alkyl with 1 to 3 carbon atoms and more preferably methyl. $R_{12}$ is preferably alkyl with 3 to 6 carbon atoms and more preferably butyl.

The bone diseases include both endogenic bone diseases such as a decrease in bone mass and exogenic bone diseases such as physical bone fractures, and an agent of the present invention can be used for treatment of the above bone diseases or for shortening a period of treatment of the above bone diseases. The endogenic bone diseases include all of diseases associated with excessive formation and/or excessive function of osteoclasts in a living body. Concrete examples of the bone diseases include, but not limited to, osteoporosis, bone disease-related hypercalcemia, bone Paget's disease, osteoclastoma, osteosarcoma, arthropathy, chronic rheumatoid arthritis, osteitis deformans, primary hyperthyroidism, osteopenia, osteoporosis, osteomalacia, traumatic bone fracture, stress fracture, or fragility of bone tissues and fractures caused by other diseases such as nutritional disorder or malignant tumor and the like, but are not limited thereto.

An administration method, formulation and dosage of a therapeutic agent for bone diseases of the present invention can be appropriately determined depending on intended use according to common pharmaceutical techniques. For instance, when administered to mammals such as human or the like for the purpose of treatment, it can be administered orally as powders, granules, tablets, capsules, balls, solvent or the like, or parenterally as injections, suppositories, percutaneous absorbents, inhalant agents or the like.

The therapeutically effective amount of the compound represented by general formula (IV) or a pharmaceutically acceptable salt thereof can be prepared as a pharmaceutical composition in combination with various carriers commonly used in the pharmaceutical composition mentioned above. The dosage varies depending on disease conditions, administration route, age or body weight of a patient, and in the case of oral administration for adults, in terms of an active component amount, usually 20 to 500 mg/kg/day and preferably 50 to 300 mg/kg/day is administered, and in the case of parenteral administration, usually 10 to 300 mg/kg/day, preferably 20 to 200 mg/kg/day is administered. This may just be administered once or in several divided doses.

Furthermore, a method of treating bone diseases comprising the step of administering the therapeutically effective amount of the compound represented by formula (IV) or a pharmaceutically acceptable salt thereof to mammals including human is provided by the present invention.

EXAMPLES

The present invention will now be concretely described by referring to Examples shown below. However, the present invention is not limited to the following Examples.

1. Obtainment of Reveromycin Biosynthesis Gene Cluster from Reveromycin-Producing Bacterium According to the following procedure, a reveromycin biosynthesis gene cluster was obtained from reveromycin-producing bacteria (S. sp. SN-593).

<Experiment Conditions>

Culture of Reveromycin-Producing Bacterium (S. sp. SN-593)

Culturing was carried out on an MS agar plate (2% soybean flour, 2% D(−)-mannitol, and 2% agar) for 2 weeks at 28° C. to allow spore formation on the plate.

A loopful of spores was inoculated with a platinum loop into 70 ml SY culture solution (0.1% yeast extract, 0.1% NZ-amine, and 1% soluble starch, pH 7.0) (in 500 ml K1 flask) and cultured for 2 days at 28° C. at 150 rpm. One milliliter of this preculture solution was inoculated into 70 m of RM-A high production medium (RM-PM) (2% potato dextrose (Difco), 1% malt extract (Difco), 1% dried yeast (Asahi Breweries, Ltd.), 5% tomato juice, 0.1% $K_2HPO_4$, 0.1% NaCl, 0.03% $MgSO_4.7H_2O$, 0.01% $NaNO_3$, 0.005% $ZnSO_4.7H_2O$, and 0.005% $CuSO_4.5H_2O$, pH 6.5 before autoclaving) or RM-A low production medium (SK2) (1.4% soluble starch, 0.35% glucose, 0.35% yeast extract, 0.21% Bactopeptone, 0.21% beef extraction liquid (difco), 0.014% $KH_2PO_4$, and 0.042% $MgSO_4$, pH 7.6) and cultured for 5 days at 28° C.

Gene Sequence Analysis

Sequence analysis was performed by whole genome shotgun sequencing for the reveromycin-producing bacterium. For this purpose, a plasmid library whose insert DNA size was 2 to 5 kb was produced. In addition, in order to comprehensively cover regions whose sequence was difficult to be analyzed, a fosmid library having insert DNA of 40 kb was produced (EPICENTRE Biotechnology). Sequence analysis was performed using BigDye terminator ver 3.1 kit (Applied Biosystems) by 3730×1 capillary sequencer (Applied Biosystems).

Obtainment of Inducible Expression PKS Gene Fragment by RT-PCR and Determination of Full Length Sequence Primers for specifically amplifying a gene with a sequence of polyketide synthesis enzyme (PKS) were designed. Using these primers, an attempt was made to obtain a gene which is amplified specifically when cultured in reveromycin production medium (the gene which is not amplified when cultured in reveromycin low production medium).

Spores of the reveromycin-producing bacterium was cultured in an SK2 medium (70 ml) for 2 days at 28° C. and 1 ml of this preculture solution was individually inoculated into 70 ml of production medium (RM-PM) and low production medium (SK2). Sixty hours later, total RNA was extracted from 5 ml culture solution using TRIzol Max Bacterial RNA isolation kit (Invitrogen). Contaminated chromosome DNA was removed by DNase I and then reverse transcription reaction was carried out using SuperScript III (Invitrogen).

PCR was carried out using TaKaRa LA-taq (Takara Bio Inc.) at 94° C. for 2 minutes and 30, 35 or 40 cycles of reactions, each of which is composed of 94° C. for seconds, 62° C. for 30 seconds, and 72° C. for 30 seconds. Primers used and abbreviated name thereof are as follows.

ketosynthase (KS), acyltransferase (AT), enoylreductase (ER):

```
                                  (SEQ ID NO: 47)
KS-F1:   TSGCSATGGACCCSCAGCAG, (SEQ ID NO: 48)
KS-R1:   CCSGTRCCGTGCGCCTCSAC, (SEQ ID NO: 49)
KSAT-F1: GTCGACACSGCCTGYTCSTC, (SEQ ID NO: 50)
KSAT-R1: GCGGCGATCTCGCCCTGSGAGTG, (SEQ ID NO: 51)
ER-F1:   GTGGGCSTGAACTTCCGCGACGT, (SEQ ID NO: 52)
ER-F2:   GACGTGSTGAMCGSCCTCGGGATG, (SEQ ID NO: 53)
ER-F3:   GCSGGSGTCGTCACCGCCGTCGG, (SEQ ID NO: 54)
ER-R1:   CGGCAGCAACCGCAGCGASGCGTC, (SEQ ID NO: 55)
ER-R2:   GGTCTTGCCCATCTCSASGAASCG, (SEQ ID NO: 56)
ER-R3:   GACGACCTTGCCCACATGACG.
```

KS, KS-AT and ER primers were designed so as to amplify 0.6, 1.5 and 0.7 kb fragments, respectively.

A gene fragment amplified specifically in RM-PM medium was ligated with pGEM-T Easy vector (Promega) and used to transform *Escherichia coli* (*E. coli* DH5α). The plasmid was collected and sequence thereof was analyzed using M13 forward and M13 reverse primers.

Figure 1:
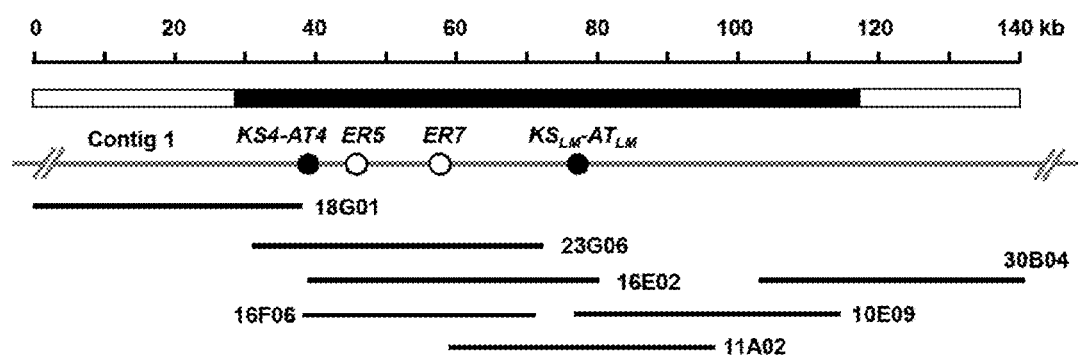
FIG. 1 shows structure of the reveromycin biosynthesis gene cluster of S. sp. SN-593. (a) A map of 140-kb region includes information of contigs for whole genome shotgun sequencing, KS-AT (●) and ER (○) sequences used for RT-PCR, and 7 fosmid clones (10E09, 11A02, 16E02, 16F06, 18G01, 23G06 and 30B04). The gene regions predicted to be involved in reveromycin biosynthesis are bolded. (b) Structure of the genes in the reveromycin biosynthesis gene cluster is shown.
Figure 1:
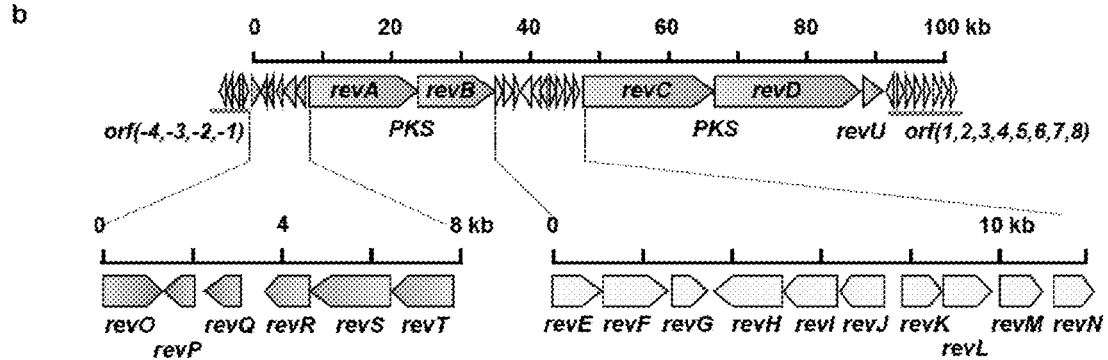

As a result of combining information of DNA fragment amplified specially in reveromycin production medium with contig information obtained by genome draft sequence, about 70% of the determined polyketide synthesis enzyme (PKS) sequences were consolidated in neighboring contig information. In addition, fosmid clones were selected by DNA hybridization analysis using candidate probes and sequence thereof was analyzed, thereby obtaining information on DNA which comprehensively covered the full length. When the obtained entire gene sequence was subjected to Frame Plot and BLAST analysis, RM-A biosynthesis gene cluster having a full length of 91 kb composed of 21 genes was successfully obtained (FIG. 1). Based on the gene sequence, PKS gene was presumably composed of 13 modules and 64 domains.

Table 1 shows the ORF size of each of the identified genes, putative function of each of the ORFs, protein having a high homology thereto, % identity thereto, and the accession number of the protein having a high homology. Any ORFs encoded by these genes had a low homology to a known amino acid sequence.

TABLE 1

| Orf | Protein size (amino acid) | Proposed function | Best blast hit (species) | Identity/ similarity (%)[a] | GenBank Accession number |
|---|---|---|---|---|---|
| orf(−4) | 302 | Amidohydrolase | Amidohydrolase 2 (*Burkholderia graminis* C4D1M) | 56/69 | EDT12820 |
| orf(−3) | 227 | Unknown | Hypothetical protein (*Arthrobacter chlorophenolicus* A6) | 76/84 | ACL41317 |
| orf(−2) | 341 | Amidohydrolase | Amidohydrolase 2 (*Streptomyces ghanaensis* ATCC 14672) | 81/88 | EFE66061 |
| orf(−1) | 219 | Transcriptional regulator | GntR family transcriptional regulator (*Streptomyces albus* J1074) | 65/77 | EFE82099 |
| revO | 433 | Transporter | Sodium:dicarboxylate symporter (*Burkholderia graminis* C4D1M) | 60/78 | ETD12818 |
| revP | 224 | Transcriptional regulator | GntR family transcriptional regulator (*Streptomyces flavogriseus* ATCC 33331) | 73/85 | EEW72869 |
| revQ | 277 | Transcriptional regulator | SARP family transcriptional regulator (*Streptomyces violaceusniger* Tu 4113) | 83/92 | EFN14605 |
| revR | 333 | 3-oxoacyl-ACP synthase | 3-oxoacyl-ACP synthase III (*Kitasatospora setae* KM-6054) | 67/80 | BAJ32310 |
| revS | 579 | Unknown | Hypothetical protein (*Kitasatospora setae* KM-6054) | 65/76 | BAJ32311 |
| revT | 443 | CoA reductase | Crotonyl CoA reductase (*Kitasatospora setae* KM-6054) | 73/86 | BAJ32312 |
| revA | 5210 | Polyketide synthase | Polyketide synthase B (*Streptomyces ambofaciens* ATCC 23877) | 51/62 | CAJ88175 |
| revB | 3724 | Polyketide synthase | Polyketide synthase (*Streptomyces spiroverticillatus*) | 55/67 | ABW96541 |
| revC | 6284 | Polyketide synthase | ObsA (*Saccharopolyspora spinosa*) | 51/62 | AAS00419 |
| revD | 7030 | Polyketide synthase | Polyketide synthase (*Micromonospora* sp. L5) | 51/63 | EFC63046 |
| revE | 367 | Dehydrogenase | Alcohol dehydrogenase (*Streptomyces violaceusniger* Tu 4113) | 79/88 | EFN13262 |
| revF | 483 | Aldehyde dehydrogenase | Aldehyde dehydrogenase (*Streptomyces violaceusniger* Tu 4113) | 82/92 | EFN13261 |
| revG | 273 | Dehydrogenase | Short-chain dehydrogenase/reductase (*Streptomyces violaceusniger* Tu 4113) | 91/95 | EFN13260 |
| revH | 507 | Monooxygenase | FAD dependent oxidoreductase (*Streptomyces violaceusniger* Tu 4113) | 81/89 | EFN13257 |
| revI | 397 | Monooxygenase | P450 (*Streptomyces* sp. AA4) | 65/79 | EFL09915 |
| revJ | 336 | Unknown | 40-residue YVTN family β-propeller repeat protein (*Streptomyces violaceusniger* Tu 4113) | 78/89 | EFN13256 |
| revK | 314 | Unknown | hypothetical protein (*Streptomyces scabiei* 87.22) | 37/56 | CBG75337 |
| revL | 357 | Unknown | Hypothetical protein (*Streptomyces neyagawaensis*) | 63/76 | AAZ94384 |
| revM | 320 | Unknown | Quinone oxidoreductase (*Micromonospora* sp. L5) | 66/77 | EFC61094 |
| revN | 305 | Esterase/lipase/ thioesterase | α/β hydrolase fold-3 domain protein (*Streptomyces violaceusniger* Tu 4113) | 89/96 | EFN13255 |
| revU | 923 | Transcriptional regulator | Transcriptional regulator (*Streptomyces violaceusniger* Tu 4113) | 79/86 | EFN12913 |
| orf1 | 325 | Unknown | Hypothetical protein (*Catenulispora acidiphila* DSM 44928) | 53/65 | ACU72805 |
| orf2 | 563 | Transporter | Binding-protein-dependent transport systems inner membrane component (*Starkeya novella* DSM 506) | 37/57 | ADH87848 |
| orf3 | 404 | Transporter | ABC transporter ATPase subunit (*Thermofilum pendens* Hrk 5) | 45/58 | ABL78949 |
| orf4 | 390 | Peptidase | Peptidase M24 (*Azoarcus anaerobius*) | 29/50 | ABK58632 |
| orf5 | 354 | Oxidoreductase | Oxidoreductase domain-containing protein (*Verminephrobacter eiseniae* EF01-2) | 34/46 | ABM59287 |
| orf6 | 340 | Dehydrogenase | D-3-phosphoglyceratedehydrogenase (*Methanocaldococcus jannaschii* DSM 2661) | 38/58 | AAB99020 |
| orf7 | 297 | Hydrolase | Fumarylacetoacetate hydrolase family protein (*Agrobacterium vitis* S4) | 42/55 | ACM40079 |

TABLE 1-continued

| Orf | Protein size (amino acid) | Proposed function | Best blast hit (species) | Identity/ similarity (%)[a] | GenBank Accession number |
|---|---|---|---|---|---|
| orf8 | 322 | Unknown | Hypothetical protein (*Catenulispora acidiphila* DSM 44928) | 45/64 | ACU72804 |

ACP, acyl-carrier-protein.

(Experimental Procedure) Preparation of Gene Disruption Plasmid

In order to confirm that the thus obtained candidate gene cluster is surly the RM-A biosynthesis gene cluster, double gene disruption of polyketide biosynthesis genes, revC and revD was carried out. The 3' terminus region of revC and the 5' terminus region of revD were deleted and aphII gene (about 1.6 kb) involved in becoming resistant to kanamycin was incorporated into the inside thereof. Further, a vector for conjugational transfer containing a homologous recombinant DNA region of about 2.5 kb in the upstream and downstream of aphII gene was prepared. Using the same technique, a plasmid for producing a strain with double gene disruption of revH and revI was constructed (FIG. 4A). Also, in order to carry out gene disruption of a cluster boundary of orf (−1) (SEQ ID NO: 31), orf1 (SEQ ID NO: 45) and revG, the inside sequence of each of the genes was replaced with aphII gene, and a gene disruption vector containing a homologous recombinant DNA region of about 2.5 kb was similarly prepared in the upstream and downstream. The followings are concrete procedures.

In order to construct a plasmid for double disruption of revC and revD, revC fragment of 2.5-kb and revD fragment of 2.7-kb were subjected PCR with fosmid clone (11A02 for revC and 30B04 for revD) as a template using revC-Eco-Bam-F (5'-CCGGAATTCGGATCCGCCGGCTGCAC-GAGGAGTCGTCG-3'SEQ ID NO: 57) and revC-Hind-Asc-R(5'-CCCAAGCTTGGCGCGCCTCGGGTGCGTCCT-GCGCGGTG-3'SEQ ID NO: 58) for revC and revD-Hind-Asc-F(5'-CCCAAGCTTGGCGCGCCTGCCCGACGT-GATCGACGACGC-3'SEQ ID NO: 59) and revD-Xho-Bam-R(5'-CCGCTCGAGGGATCCAGCCCCTCGGCCAC-CGACA-3'SEQ ID NO: 60) for revD as primers.

The amplified revC fragment was digested with EcoRI and HindIII and inserted into pET-Duet vector (Novagen), thereby obtaining pET-C. The amplified revD fragment was digested with HindIII and XhoI and inserted into pET-C, thereby obtaining pET-CD. aphII gene amplified using primers with a HindIII site (aph-Hind-F: 5'-CTCGAGAAGCT-TCAGTGAGTTCGAGCGACTCGAGA-3' and aph-Hind-R: 5'-CTCGAGAAGCTTCTGGTACCGAGCGAACGCG-TA-3'SEQ ID NO: 61, 62) was digested with HindIII and inserted into a HindIII site of pET-CD to construct pET-CaphD. The obtained pET-CaphD was digested with BamHI and the obtained cassette for double disruption of revC and revD was introduced into a BamHI site of a conjugation plasmid pIM, thereby obtaining pIM-CaphD.

Disruption of revG, orf (−1), and orf1 was performed by gene substitution by PCR (λ-Red system) (Proc Natl Acad Sci USA 100, 1541-6 (2003)). Fosmids 11A02, 18G01 and 30B04 were used as a template for gene substitution of revG, orf (−1), and orf1, respectively, and respective primers listed in Table 2 were used. However, because it was difficult to introduce a large size gene into S. sp. SN-593, a DNA fragment of about 6.6 kb containing a disruption type gene was amplified by primers in Table 3 below and this was inserted into a HindIII site in a pIM conjugation vector. A scheme for revG disruption is shown in FIG. 3a.

Figure 12:
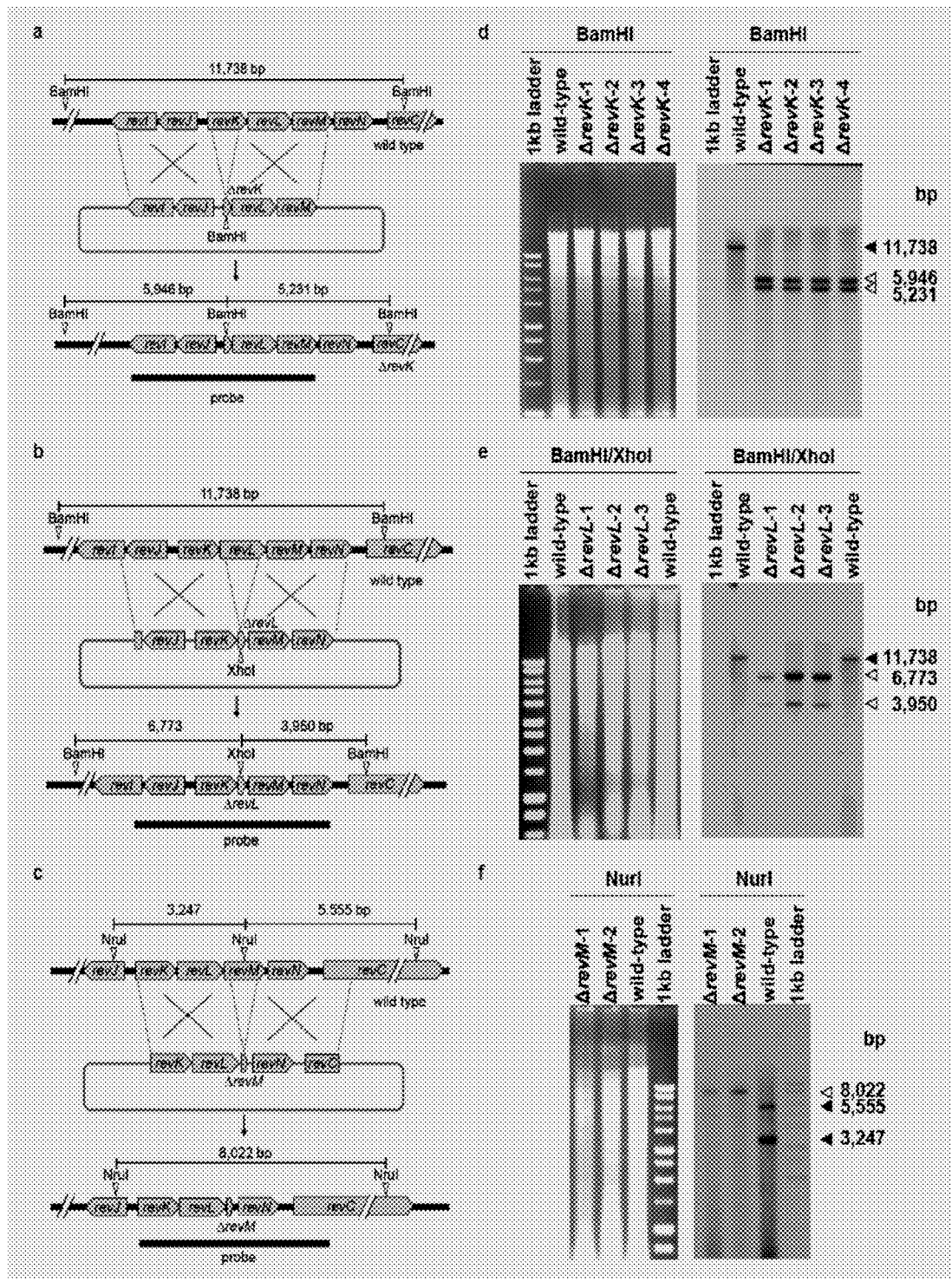
FIG. 12 shows disruption of revK, revL, and revM genes, and southern blotting analysis (photograph). (a) A scheme of revK disruption and restriction maps of a wild type and ΔrevK strain. Bars represent the expected fragment size (bp) upon digestion with BamHI. (d) Southern blotting analysis (right) (photograph) for wild type (lane 2) and ΔrevK (lanes 3, 4, 5 and 6). EtBr staining is shown in the left. (b) A scheme of revL disruption and restriction maps of a wild type and ΔrevL strain. Bars represent the expected fragment size (bp) upon digestion with BamHI and XhoI. (e) Southern blotting analysis (right) (photograph) for wild type (lanes 2 and 6) and ΔrevL (lanes 3, 4 and 5). EtBr staining is shown in the left. (c) A scheme of revM disruption and restriction maps of a wild type and ΔrevM strain. Bars represent the expected fragment size (bp) upon digestion with NruI. (f) Southern blotting analysis (right) (photograph) for wild type (lane 3) and ΔrevM (lanes 1 and 2). EtBr staining is shown in the left.

Gene disruption was carried out for revE, revK, and revM by the same procedure. A scheme for revE, revK, and revM disruption is shown in FIG. 12.

revL gene disruption was carried out by the following technique. First, PCR was carried out with fosmid clone (11A02) as a template using RevL-Hind-F (5'-CCCAAGCT-TGGACTTCGCCTGCGCGTTGAACTT-3' SEQ ID NO: 83) and revL-Hind-R (5'-CCCAAGCTTAGGCTTCCTG-GAGGAAGTCCGTCA-3' SEQ ID NO: 84) as primers such that the both terminus of revl gene had 2.5-kb homologous recombination region. This gene fragment was introduced into a HindIII site of pUC19. Using this as a template, PCR was carried out with revL-Xho-F (5'-CCGCTC-GAGAACGCCCCGGAGGGCATCTACTGA-3' SEQ ID NO: 85) and revL-Xho-R (5'-CCGCTCGAGCTGGTCGAC-CAGAGCCAGTGATTC-3' SEQ ID NO: 86) as primers (so as) to remove a revL region and the resultant was subjected to DpnI treatment and XhoI excision, followed by self ligation. A gene fragment having a region where RevL was disrupted was excised with HindIII and introduced into a HindIII site of a pIM disruption vector.

TABLE 2

```
ΔrevG    revG-For-P4: SEQ ID NO: 63
(11A02)  5'-ATGACGCGACGACTCGACGGTAAGGTGGCCATGATCACGATTCCGGGGATCCGTCGACC-3'
         revG-Rev-P1: SEQ ID NO: 64
         5'-TTACGGGTGGTGAAGCCGGCGTCGATCGGCAGCGCGATTGTAGGCTGGAGCTGCTTC-3'

Δorf(-1) orf(-1)-For-P4: SEQ ID NO: 65
(18G01)  5'-ATGAAGGGAGTCGCCGCGCGGCTCCACGTCGGCGCCCGGATTCCGGGGATCCGTCGACC-3'
         orf(-1)-Rev-P1: SEQ ID NO: 66
         5'-ATCGCTCGCCCGCAACTGCGCGATGACGCCGGCCAGCTGTGTAGGCTGGAGCTGCTTC-3'

Δorf1    orf1-For-P4: SEQ ID NO: 67
(30B04)  5'-GTGTCCTCGCTGAAGTCGACGTTCACCGTCTATCCGCACATTCCGGGGATCCGTCGACC-3'
         orf1-Rev-P1: SEQ ID NO: 68
         5'-TCAGGCCGTCGGGTAGTCGCCGGGCGCGAAGATCTCCTCTGTAGGCTGGAGCTGCTTC-3'
```

TABLE 2 -continued

ΔrevK    revK-For-P4:: SEQ ID NO: 87
5'-<u>CTGACCGTCGACCGGATGCTGCGCTGGGAACTGGACCGC</u>ATTCCGGGGATCCGTCGACC-3'
revK-Rev-P1: SEQ ID NO: 88
5'-<u>GATGTCGAGCTTGGCCGGGCCGAGGAGGAACGCAAGCTGT</u>GTAGGCTGGAGCTGCTTC-3'

ΔrevM    revM-For-P4: SEQ ID NO: 89
5'-<u>GACAAGCAGCTCGTGCTGCGCGAGGTCGAGG</u>ATTCCGGGGATCCGTCGACC-3'
revM-Rev-P1: SEQ ID NO: 90
5'-<u>CGGCAGCAGGAGGATCTTGCCGACGTGGTCGCTCGCCT</u>CTGTAGGCTGGAGCTGCTTC-3'

ΔrevE    revE-For-P4:: SEQ ID NO: 91
5'-<u>CACACCGACCTGGCCGTCCAGCACGGGTTCACGCCCTTC</u>ATTCCGGGGATCCGTCGACC-3'
revE-Rev-P1: SEQ ID NO: 92
5'-<u>GAACGTGTGCGGGTCGCTGTCGCCCTCGACGACGCCGAC</u>TGTAGGCTGGAGCTGCTTC-3'

Homologous sequences used for homologous recombination are underlined.

TABLE 3

| | |
|---|---|
| revG<br>(11A02 with ΔrevG) | ΔrevG-Hind-For: SEQ ID NO: 69<br>5'-CCC<u>AAGCTT</u>ACGTGGCGCTGTCGTTCGCGAGCT-3'<br>ΔrevG-Hind-Rev: SEQ ID NO: 70<br>5'-CCC<u>AAGCTT</u>CCCACCGGCTCATCGACGACATGC-3' |
| orf(-1)<br>(18G01 with Δorf(-1)) | Δorf(-1)-Hind-For: SEQ ID NO: 71<br>5'-CCC<u>AAGCTT</u>GGTAGCGGTTGTCGTGTCCGTAGA-3'<br>Δorf(-1)-Hind-Rev: SEQ ID NO: 72<br>5'-CCC<u>AAGCTT</u>GGAGCAGGAGTTGTCGGACGGCTT-3' |
| orf1<br>(30B04 with Δorf1) | Δorf1-Hind-For: SEQ ID NO: 73<br>5'-CCC<u>AAGCTT</u>GGCGACGTTCTCGAAGACGCTCAT-3'<br>Δorf1-Hind-Rev: SEQ ID NO: 74<br>5'-CCC<u>AAGCTT</u> TCGACGACATCCAGCACGTCGACT-3' |

Restriction enzyme recognition sequences are underlined.

Preparation of Plasmid for Gene Complementation

To confirm functional complementation of disrupted genes, DNA in which an aphII promoter (EcoRI, BamHI fragment) was ligated with revG gene (BamHI/HindIII fragment) was prepared and introduced into a pTYM19 vector having a function of incorporating DNA into the chromosome (J Antibiot (Tokyo) 56, 950-6 (2003)). Specifically, a fragment containing the aphII promoter was amplified from Tn5 using the primers of SEQ ID NOs: 75 and 76 and inserted into pTYM19. The obtained pTYM19-aphII was digested with BamHI and HindIII and a revG fragment amplified from 11A02 with the primers of SEQ ID NOs: 77 and 78 was inserted thereinto, thereby constructing a vector for complementing revG.

TABLE 4

| | |
|---|---|
| aphII promoter<br>(Tn5) | Aph-P-Eco: SEQ ID NO: 75<br>5'-CCG<u>GAATTC</u>ACAGCTTCACGCTGCCGCAAG<br>CACT-3'<br>Aph-P-Bam: SEQ ID NO: 76<br>5'-CGC<u>GGATCC</u>CATGCGAAACGATCCTCATCC<br>TGTC-3' |
| revG<br>(11A02) | RevG-Bam-F: SEQ ID NO: 77<br>5'-CGC<u>GGATCC</u>ATGACGCGACGACTCGACGGT<br>AAG-3'<br>RevG-Hind-R: SEQ ID NO: 78<br>5'-CCC<u>AAGCTT</u>TTACGGGGTGGTGAAGCCGGC<br>GTC-3' |

Restriction enzyme recognition sequences are underlined.

Functional complementation of disrupted revE, revK, revL and revM genes was examined. DNA in which an aphII promoter (EcoRI, BamHI fragment) was ligated with revL gene (BamHI, HindIII fragment) was prepared and was introduced into a pTYM19 vector having a function of incorporating DNA into the chromosome (J Antibiot (Tokyo) 56, 950-6 (2003)). pTYM19-aphII was digested with BamHI and HindIII, and a revL fragment amplified from 11A02 with the primers of SEQ ID NOs: 93 (RevL-Bam-F: CGCGGATCCATGAACGAATCACTGGCTCTGGTC) and 94 (RevL-Hind-R: CCCAAGCTTTCAGTAGATGCCCTCCGGGGCGTT) was inserted thereinto, thereby constructing a vector for complementing revL.

In addition, pTYM19 was digested with EcoRI and HindIII, revK and revM genes containing an endogenous promoter which was amplified using the primers of SEQ ID NOs: 95 (RevK-Eco-F: CCGGAATTCCACCGGGATGGTGACCTCCAC) and 96 (RevN-Hind-R: CCCAAGCTTTCACGTGTGTTGCGTCCAGGCTTC) from 11A02 as a template were inserted thereinto, thereby constructing a vector for complementing revK and revM.

Further, in order to confirm functional complementation of the disrupted rev E gene, pTYM19-aphII was digested with BamHI and HindIII, and a revE fragment amplified from 11A02 with the primers of SEQ ID NOs: 97 (RevE-Bam-F: CGCGGATCCATGGACATCACCGCAGCAGTGATC) and 98 (RevE-Hind-R: CCCAAGCTTTCACCGGTGCGTGAGCACCACCTT) was inserted thereto, thereby constructing a vector for complementing revE.

Gene Transfer—Disruption by Conjugational Transfer Method

Gene transfer was carried out by a conjugational transfer method from *Escherichia coli* to the reveromycin-producing bacterium. *Escherichia coli* GM2929 hsdS::Tn10 (pUB307::Tn7) (Proc Natl Acad Sci USA 107, 2646 (Feb. 9, 2010)) was used and pIM vector was used for a vector for conjugational transfer, which pIM vector was optimized by removing a BamHI-KpnI region from pKU250 (Proc Natl Acad Sci USA 107, 2646 (Feb. 9, 2010)). For selection of *Escherichia coli* having the gene disruption vector, LB (1% tryptone, 0.5% yeast extract, 1% NaCl) medium containing kanamycin (25 μg ml$^{-1}$), chloramphenicol (30 μg ml$^-$), streptomycin (50 μg ml$^{-1}$) and spectinomycin (100 μg ml$^{-1}$) was used. In the case of having a vector for gene complementation, ampicillin (50 μg ml$^-$), instead of kanamycin, was used.

Spores of the reveromycin-producing bacterium were prepared, cultured in an SY medium at 28° C. for 4 hours, mixed with *Escherichia coli* GM2929 hsdS::Tn10 (pUB307::Tn7) containing the gene disruption vector at a ratio of 50:1, and inoculated on an MS2 (3% soybean flour, 2% D(−)-mannitol, 25 mM MgCl$_2$, 2% agar) (20 ml) plate. After culturing at 28° C. for 20 hours, thiostrepton and carumonam were added at a final concentration of 20 μml$^{-1}$ and 5 μg ml$^{-1}$, respectively, and the culture was carried forward for another one week. In the case of gene complementation, transformation was completed by selection of thiostrepton-resistant clones, while in the case of gene disruption, the clones were further subjected to secondary selection on an MS plate containing 0.4 μml$^{-1}$ ribostamycin and the obtained resistant clones were subjected to liquid culture in an SY medium (70 ml) containing no agar, followed by spore formation on an MS plate. A colony obtained from a single spore was prepared and ribostamycin-resistant and thiostrepton-sensitive clones were selected.

Verification of Gene Disruption

To verify gene disruptants, southern hybridization analysis was carried out (FIG. 3*b*). Using PrimeSTAR HS DNA polymerase (TaKaRa), each probe was prepared. A reaction was performed at 98° C. for 10 seconds, followed by 25 cycles of PCR reactions, each of which composed of 98° C. for 10 seconds, 67° C. for 5 seconds and 68° C. for 2.5 minutes or at 98° C. for 10 seconds, followed by 25 cycles of PCR reactions, each of which composed of 98° C. for 10 seconds, 67° C. for 5 seconds and 68° C. 40 seconds. The amplified DNA fragment was excised from a gel, purified, and labeled by AlkPhos Direct Labelling Reagents (GE Healthcare).

Extraction of Metabolites from Gene Disruptant

A wild type strain (*Streptomyces* sp. SN-593) and gene disruptant were cultured on an SY medium for 2 days. After that, 1 ml of preculture solution was inoculated into an RM-PM (70 ml) medium and cultured for another 5 days. Subsequently, an equal amount of acetone was added and stirred, and then acetone was removed. The pH was adjusted to 4 with acetic acid and an equal amount of ethyl acetate was added and extraction was carried out twice. Ethyl acetate was then removed and the resultant was dissolved in 20 ml of methanol, followed by LC-MS analysis. For ESI-MS analysis, WatersAlliance HPLC system equipped with mass spectrometer (Q-TRAP, Applied Biosystems) was used. As for HPLC, analysis was carried out using A solvent: 0.05% formic acid aqueous solution, B solvent: acetonitrile, and XTerra (trademark) MSC18 5 μm (2.1 mm i.d.×150 mm) column at a flow rate of 0.2 ml min$^{-1}$. A sample was loaded onto a column equilibrated with 30% B solvent, eluted with a linear gradient from 30% to 100% B solvent for 20 minutes, and further eluted with 100% B solvent for another 20 minutes. Mass spectrum analysis was carried out on ESI-negative mode.

<Results>

As a result of analysis of orf(−1) disruptant and orf1 disruptant, both of these strains showed no difference in terms of production of reveromycins as compared with a wild type strain. Therefore, these genes were thought not to be involved in a reveromycin biosynthesis system.

Because generation of reveromycin A was observed in a ΔrevCΔrevD double mutant strain, revC and revD were thought to be involved in biosynthesis of reveromycin A. But when RM-A1a was added to the ΔrevCΔrevD double mutant strain, reveromycin A was generated, implying that revC and revD were involved in a reaction upstream of RM-A1a (FIG. 2). It was confirmed that each of the RevA, RevB, RevC, and RevD gene products functioned as polyketide synthase (PKS).

Figure 3:
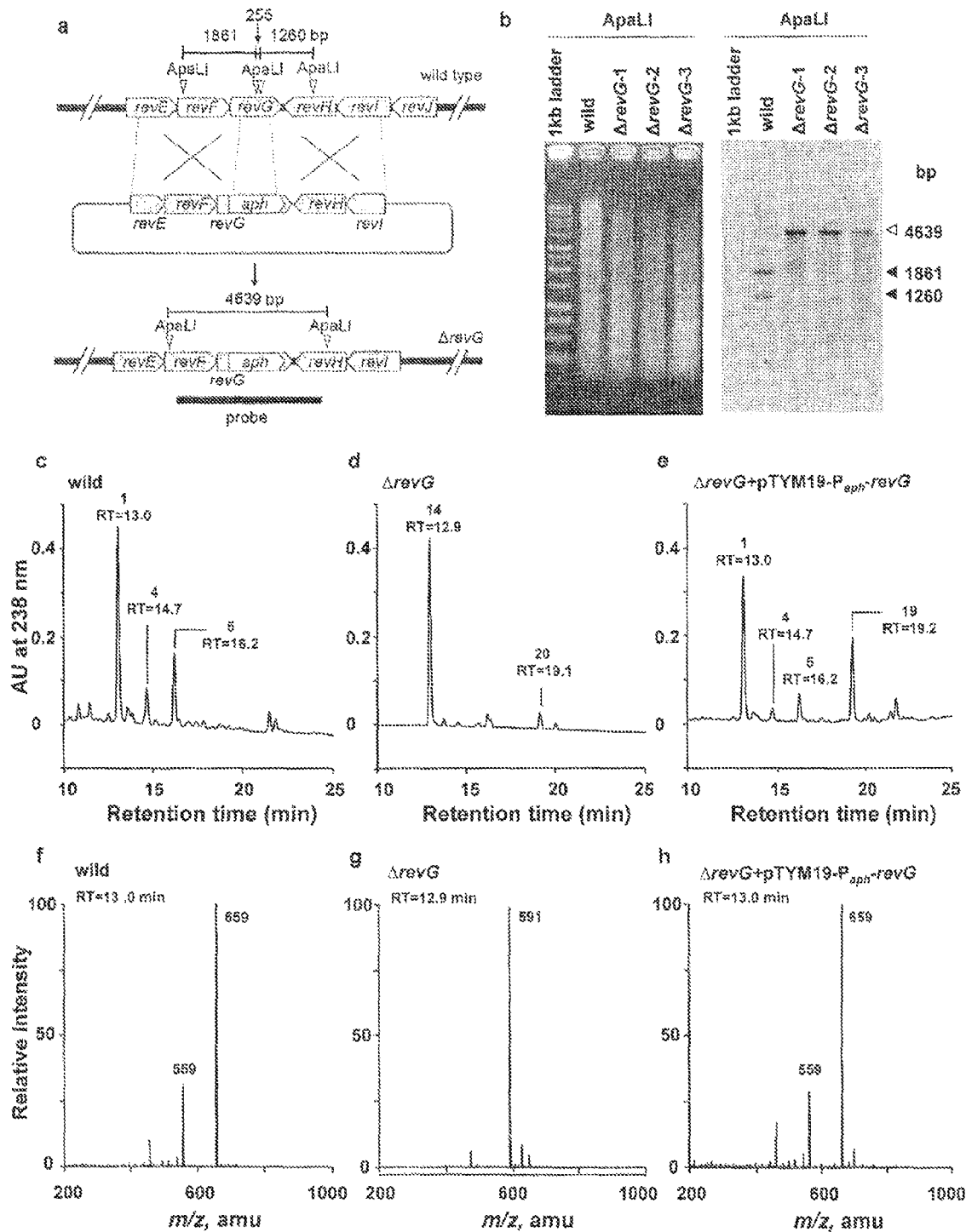
FIG. 3 shows revG gene disruption and southern blotting and metabolite analysis. (a) A scheme for revG disruption and, restriction maps of wild type and ΔrevG strain. Bars represent the expected fragment size (bp) upon digestion with ApaLI. (b) Southern blotting analysis (right) (photograph) of wild type (lane 2) and ΔrevG (lanes 3, 4 and 5). EtBr staining is shown in the left. (c and f) LC-MS analysis of reveromycin compound from culture extract of a wild type strain. (d and g) LC-MS analysis of reveromycin compound from culture extract of a ΔrevG strain. (e and h) LC-MS analysis of reveromycin compound from culture extract of a strain obtained by complementing a ΔrevG strain with pTYM19-P$_{aph}$-revG. 1 (RT=13.0, m/z 659 [M-H]$^-$), 4 (RT=14.7, m/z 687 [M-H]$^-$), 5 (RT=16.2, m/z 659 [M-H]$^-$), 19 (RT=19.2, m/z 543 [M-H]$^-$), and 20 (RT=19.1, m/z 573 [M-H]$^-$)

On the other hand, reveromycin A was not generated and RM-A1a was accumulated in a ΔrevG strain (FIGS. 3*d* and *g*). When revG was complemented in a ΔrevG strain, reveromycin A was generated (FIG. 3 *e* and *h*). Therefore, revG was thought to be involved in a reaction between RM-A1a and reveromycin A. RM-A1a was purified using C$_{18}$-HPLC (Pegasil ODS 10 mm i.d.×250 mm) with acetonitrile/0.05% and formic acid aqueous solution (65:35). RM-Ale was obtained by culturing a ΔrevG strain for 5 days or longer. RM-Ale was purified using C$_{18}$-HPLC (Pegasil ODS 10 mm i.d.×250 mm) with acetonitrile/0.05% and formic acid aqueous solution (70:30).

A strain in which ΔrevG was complemented with revG gene was cultured in 70 ml of SY medium at 28° C. for 2 days (rotary shaker, 150 rpm). One milliliter of whole culture solution was added to 70 ml of RM-PM medium and cultured for 5 days. All 5 l of culture solution was extracted, thereby obtaining 2.5 g of crude extract. This was subjected to SiO$_2$ column chromatography and eluted with a stepwise concentration gradient of chloroform/methanol (methanol; 9 steps of from 0 to 100%). Nine fractions were obtained. A fraction eluted with chloroform/methanol (5:1) was purified with C$_{18}$-HPLC (Pegasil ODS 20 mm i.d.×250 mm) methanol/0.05% formic acid aqueous solution (83:17) to obtain 9.71 mg of RM-T. This RM-T was efficiently transformed into reveromycin A in a ΔrevCΔrevD strain, implying that RM-T was an intermediate in the biosynthesis.

Figure 4:
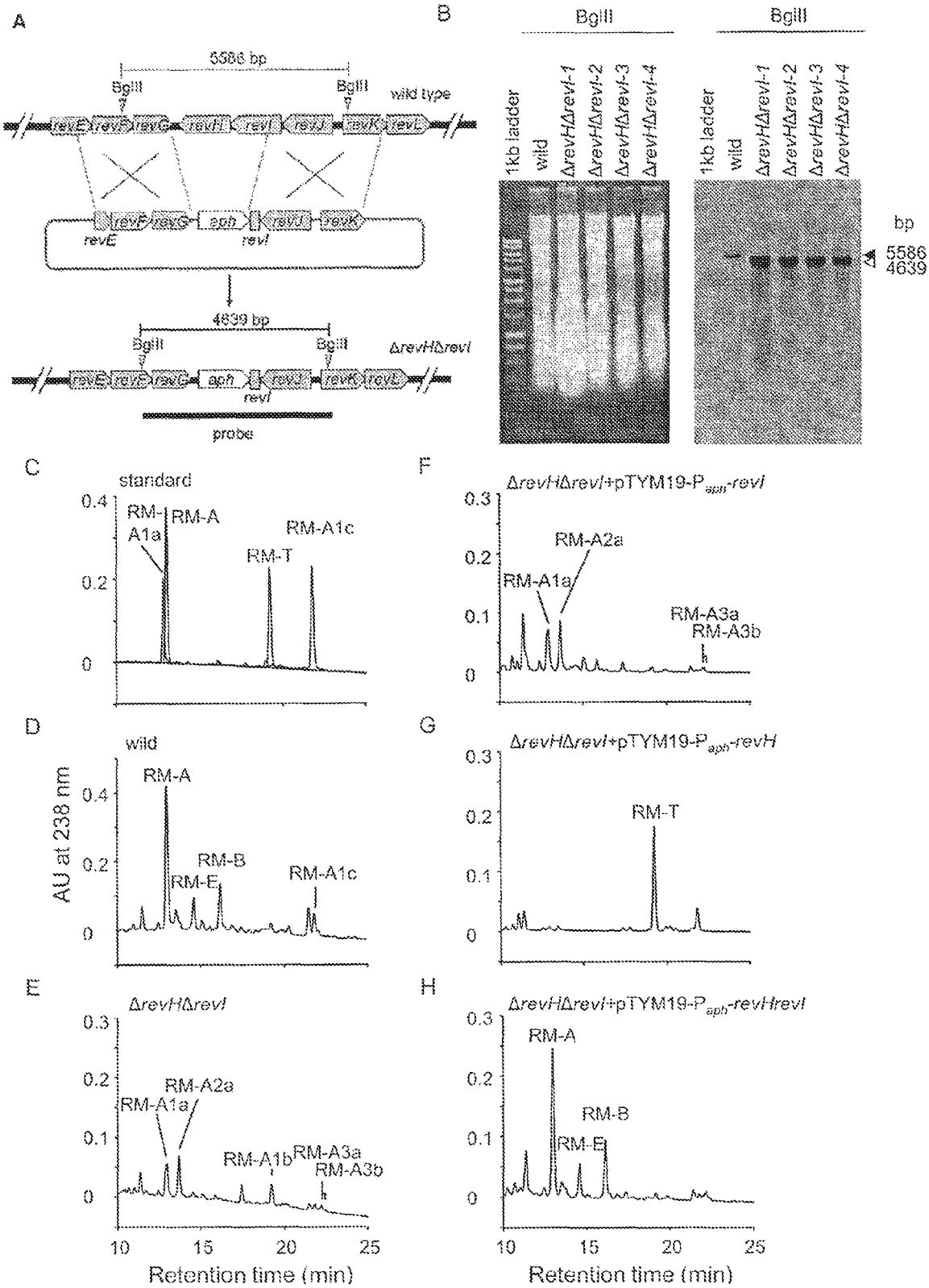
FIG. 4 shows a scheme for ΔrevHΔrevI double gene disruption (A), confirmation of gene disruption (B) (photograph) and results of metabolite analysis (C: standard, D: wild type strain, E: ΔrevHΔrevI double gene disruptant, F: reintroduction of pTYM19-P$_{aph}$-revI into ΔrevHΔrevI double gene disruptant, G: reintroduction of pTYM19-P$_{aph}$-revH into ΔrevHΔrevI double gene disruptant, H: reintroduction of pTYM19-P$_{aph}$-revHrevI into ΔrevHΔrevI double gene disruptant).

From FIG. 4, ΔrevHΔrevI double gene disruptant exhibited a phenotype accumulating RM-A1a and RM-A2a as major intermediate products and concurrently an extremely small amount of RM-A3a and RM-A3b. In contrast to this, a strain in which revI was reintroduced (revH disruptant) exhibited the same phenotype as the ΔrevHΔrevI double gene disruptant but a strain in which revH was reintroduced (revI disruptant) accumulated RM-T. From this, it was found that a RevI gene product functioned as RM-T hydroxylase and a revI disruptant was useful as a RM-T producing strain, and that RM-T is a stable derivative of RM.

When a RevS protein was heterologously expressed using *Escherichia coli* and purified to speculate a function thereof, it was found that the protein was CoA ligase specific to unsaturated fatty acids.

When a RevT protein was heterologously expressed using Actinomycetes (*Streptomyces lividans* TK23) and purified to speculate a biochemical function thereof, it was found that the protein generated butyl malonyl CoA and hexyl malonyl CoA using trans-2-hexenoyl-CoA and trans-2-octenoyl-CoA as substrates.

By heterologously expressing RevH and RevN proteins using *Escherichia coli* and purifying the proteins, it was found that RevN was an esterase breaking ester bonds generated by Baeyer-Villiger oxidase RevH.

Result of Function Analysis for revK, revL and revM Gene

Introduction of hemisuccinate to a tertiary hydroxyl group is difficult. In organic chemistry, a reaction under extremely high pressure such as 15,000 atm is carried out. But reveromycin-producing bacterium is able to carry out a biosynthetic reaction at room temperature under ordinary pressure. In order to uncover a mechanism for forming hemisuccinate thereby RM-A was generated from C18-hydroxy RM-T (RM-T1), each of the gene disruption of revK, revL, and revM was analyzed. FIG. 12 shows confirmatory results of gene disruption and by southern hybridization (ΔrevK (FIG. 12 *a* and *d*), ΔrevL (FIGS. 12 *b* and *e*), and ΔrevM (FIGS. 12 *c* and *f*)). Next, biosynthesis intermediate products accumulated in revK, revL and revM gene disruptants were analyzed.

Figure 13:
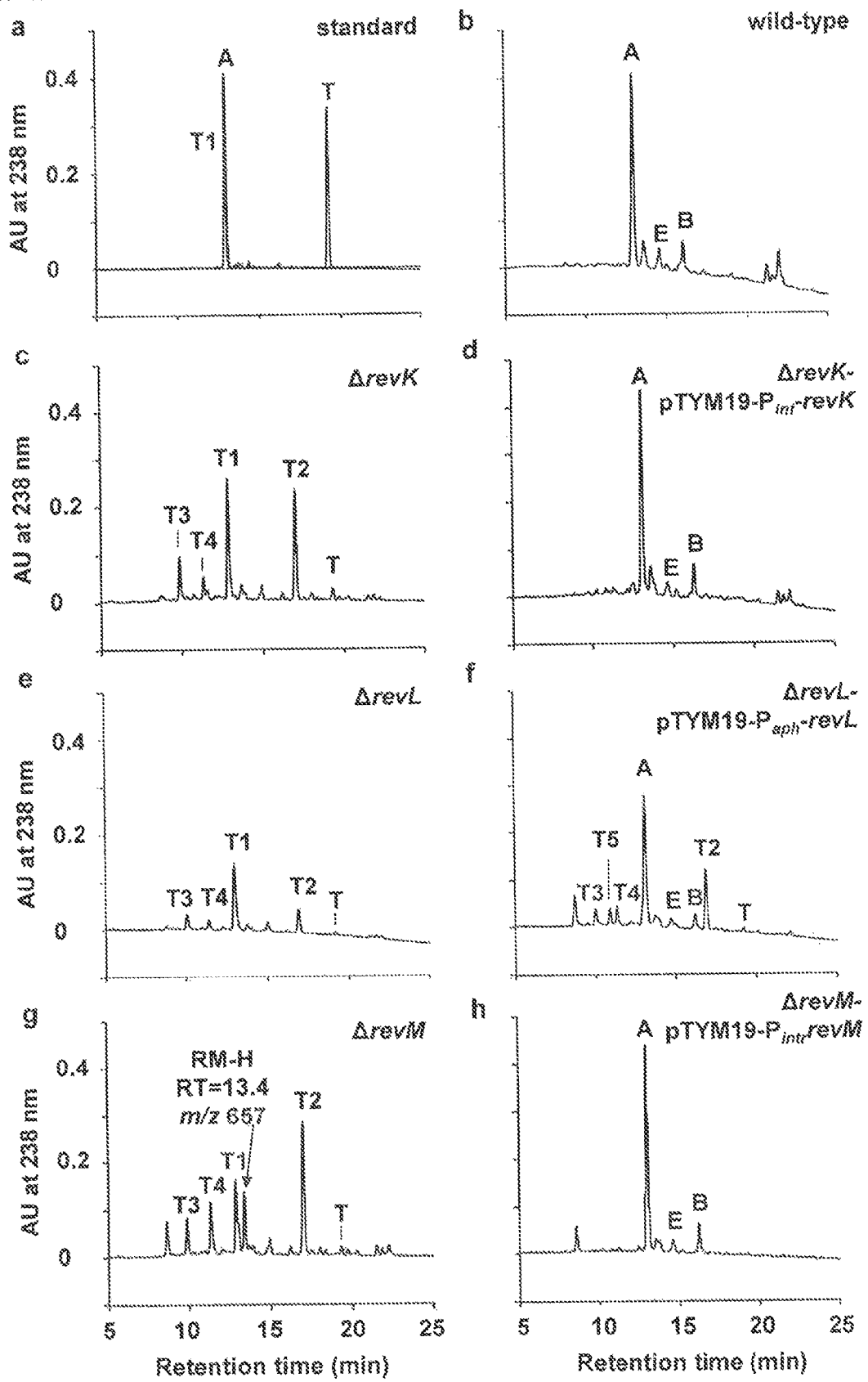
FIG. 13 shows LC-MS analysis of reveromycin compound from culture extract of the ΔrevK, ΔrevL, and ΔrevM strain. (a) Standard. (b) LC-MS analysis of reveromycin compound from culture extract of a wild type strain. (c, e and g) LC-MS analysis of reveromycin compound from culture extract of ΔrevK, ΔrevL, ΔrevM strain. (d) LC-MS analysis of reveromycin compound from culture extract of a strain obtained by complementing a ΔrevK strain with pTYM19-P$_{int}$-revK. (f) LC-MS analysis of reveromycin compound from culture extract of a strain obtained by complementing a ΔrevL strain with pTYM19-P$_{aph}$-revL. (h) LC-MS analysis of reveromycin compound from culture extract of a strain obtained by complementing a ΔrrevM strain with pTYM19-P$_{int}$-revM.

C18-hydroxy RM-T (RM-T1) and RM-T1 with 5,6-spiroacetal moiety (RM-T2) at m/z 559 [M-H]$^-$ were mainly accumulated in a disruptant of revK gene whose function was unknown (FIG. 13*c*). In addition, two peaks (RM-T3 and RM-T4) at m/z 575 [M-H]$^-$, which were predicted as hydroxylated forms of RM-T1 and RM-T2, were detected as minor products (FIG. 13*c*). Further, it was able to be confirmed that production of RM-A was recovered when revK gene was reintroduced into the gene disruptant (FIG. 13*d*).

Similarly to a revK disruptant, in a disruptant of revL gene whose function is unknown, RM-T1 and RM-T2 at m/z 559 [M-H]$^-$ were mainly accumulated and two peaks at m/z 575 [M-H]$^-$ (RM-T3 and RM-T4) were confirmed as minor products (FIG. 13*e*). Further, it was able to be confirmed that production of RM-A was recovered by complementing revL gene (FIG. 13*f*). Because metabolites accumulated in RevK and RevL disruptants were identical, it was implied that two enzymes were necessary for a reaction after RM-T1. Furthermore, a novel related substance showing m/z 675 [M-H]$^-$ (RM-T5: C14 hydroxy RM-A) was found in the complemented strain (FIG. 13*f*).

A disruptant of revM gene whose function is unknown produced, in addition to RM-T1, T2, T3, and T4, an RM derivative at m/z 657 (FIG. 13*g*). It was able to be confirmed that production of RM-A was recovered by complementing revM gene (FIG. 13*h*). It was implied that RevM is an enzyme reducing RM-H using NAD(P)H as a coenzyme to generate RM-A. From the above analysis of gene disruption, revK and revL are novel enzymes involved in transferring fumaric acid to RM-T1.

Analysis Result of revE Gene Function

FIGS. 14*a* and *b* show confirmatory results of revE gene disruption and by southern hybridization (ΔrevK (FIGS. 12 *a* and *d*), ΔrevL (FIGS. 12 *b* and *e*), and ΔrevM (FIGS. 12 *c* and *f*)). In a ΔrevE strain, reveromycin A was not generated, RM-A6a at m/z 529 [M-H]$^-$ was accumulated as a major product and RM-A9a at m/z 645 [M-H]$^-$ was accumulated with time (FIG. 14*d*). When revE was complemented in a ΔrevE strain, reveromycin A was generated (FIG. 14*e*). Therefore, revE was found to be involved in a reaction between RM-A6a and reveromycin A.

2. Construction of Large-Scale Production System for Reveromycins

For gene transfer to enhance production of RMs, a conjugational transfer method was carried out. For constitutive expression, a promoter of a vector pTYM19 for conjugational transfer was replaced with aphII gene and a gene to be expressed was inserted in the downstream thereof. *Escherichia coli* GM2929 hsdS::Tn10 (pUB307::Tn7) was used and an LB medium containing ampicillin (50 μg ml$^{-1}$), chloramphenicol (30 μml$^{-1}$), streptomycin (50 μg ml$^{-1}$) and spectinomycin (100 μg ml$^{-1}$) was used for selection. Spores of reveromycin-producing bacterium were prepared, cultured in an SY medium at 28° C. for 4 hours culture, mixed with *Escherichia coli* containing a vector for conjugational transfer at a ratio of 50:1, and inoculated on an MS2 (20 ml) plate. After culturing at 28° C. for 20 hours, thiostrepton (final concentration 20 μg ml$^{-1}$) and carumonam (final concentration 5 μg ml$^{-1}$) were added and the culture was carried out for one week, thereby selecting a thiostrepton resistant transformant strain.

A wild type strain (*Streptomyces* sp. SN-593), revQ gene disruptant, and gene transferred strain were cultured in an SY medium for 2 days. After that, 1 ml of preculture solution was inoculated in an RM-PM medium and cultured for another 5 days. Subsequently, an equal amount of acetone was added and stirred, and then acetone was removed. The pH was adjusted to 4 with acetic acid and an equal amount of ethyl acetate was added and extraction was carried out twice. Ethyl acetate was then removed and the resultant was dissolved in methanol, followed by LC-MS analysis.

Figure 5:
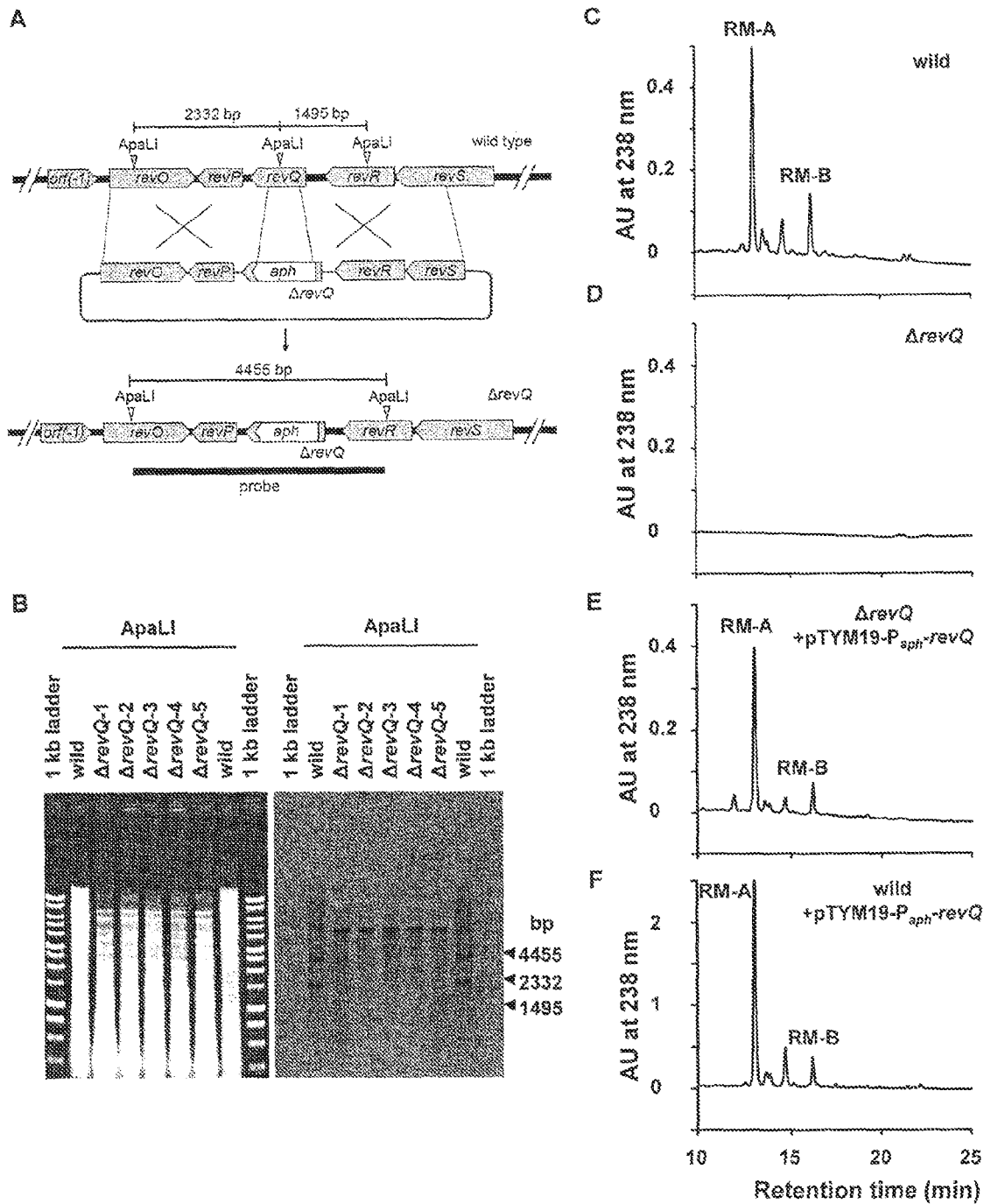
FIG. 5 shows a scheme for revQ gene disruption (A), confirmation of revQ gene disruption (B) (photograph), and results of metabolite analysis (C: wild type strain, D: revQ disruptant, E: introduction of revQ into a revQ disruptant, and F: a strain obtained by overexpressing revQ in a wild type strain).
Figure 7:
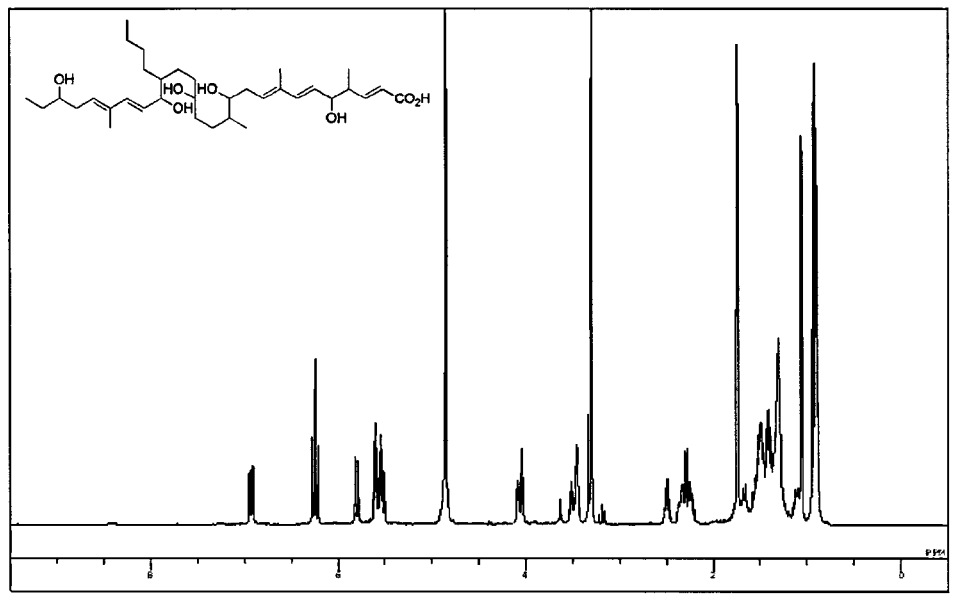
FIG. 7 shows $^1$H NMR spectrum(A) and $^{13}$C NMR spectrum(B) of RM-A1a in CD$_3$OD.
Figure 7:
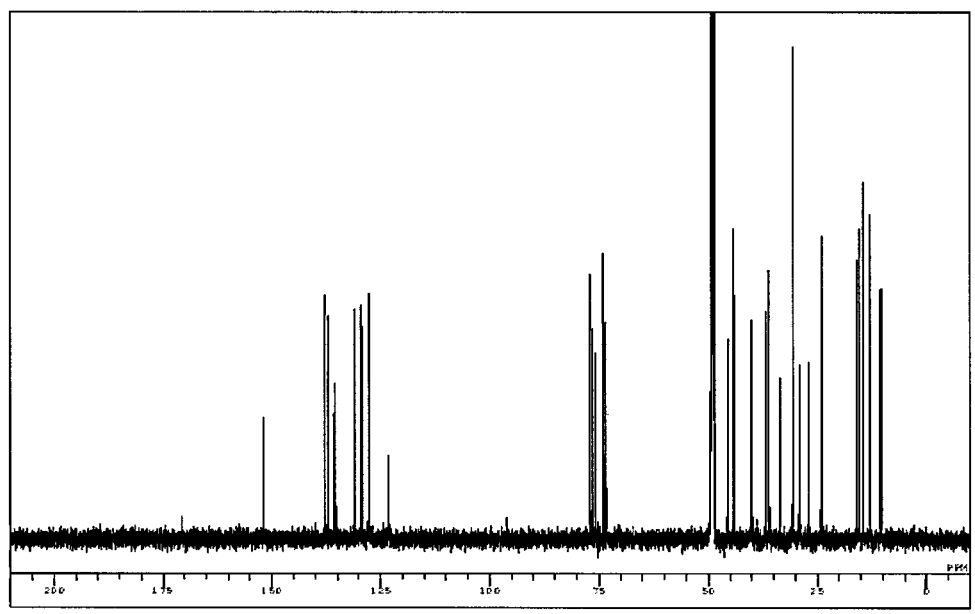
Figure 8:
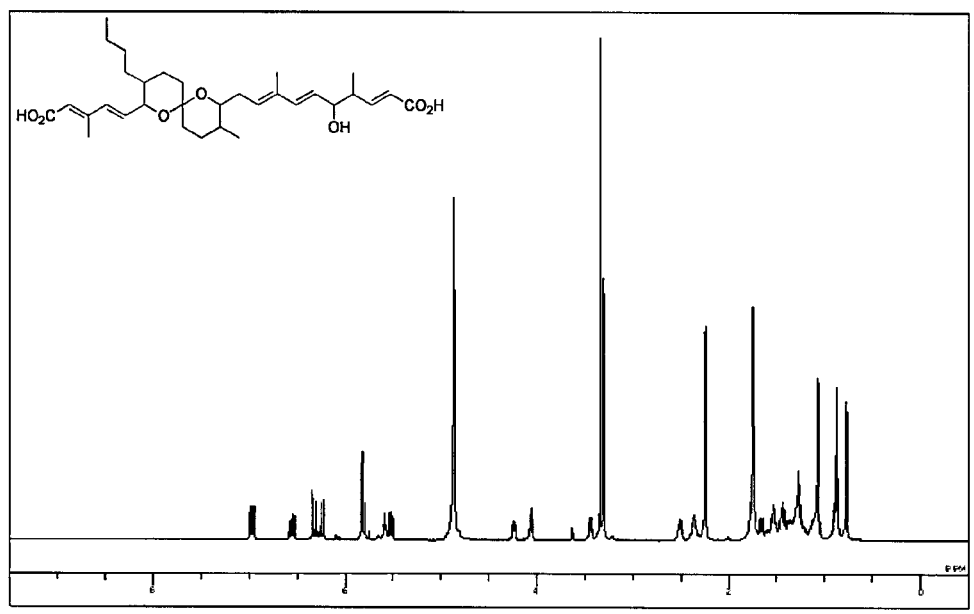
FIG. 8 shows $^1$H NMR spectrum(A) and $^{13}$C NMR spectrum(B) of RM-T in CD$_3$OD.
Figure 8:
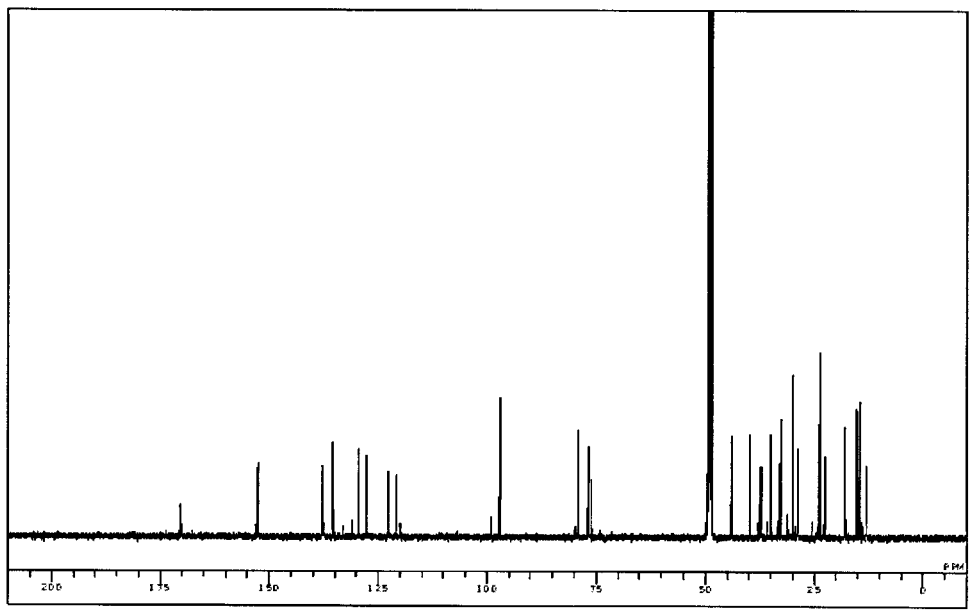
Figure 9:
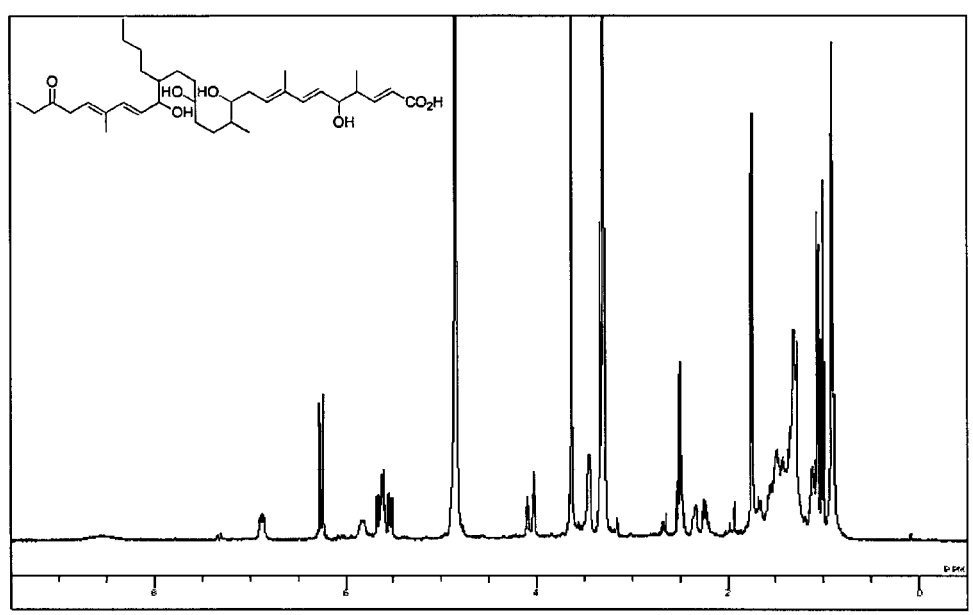
FIG. 9 shows $^1$H NMR spectrum of RM-A2a in CD$_3$OD.
Figure 10:
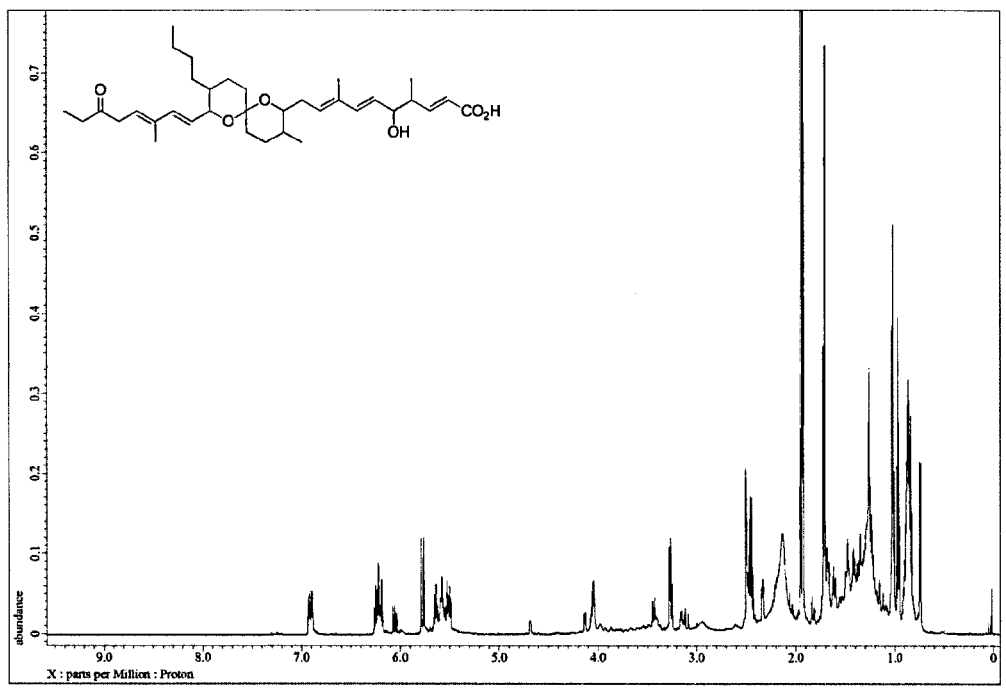
FIG. 10 shows $^1$H NMR spectrum(A) and $^{13}$C NMR spectrum(B) of RM-A3a and A3b in CD$_3$OD.
Figure 10:
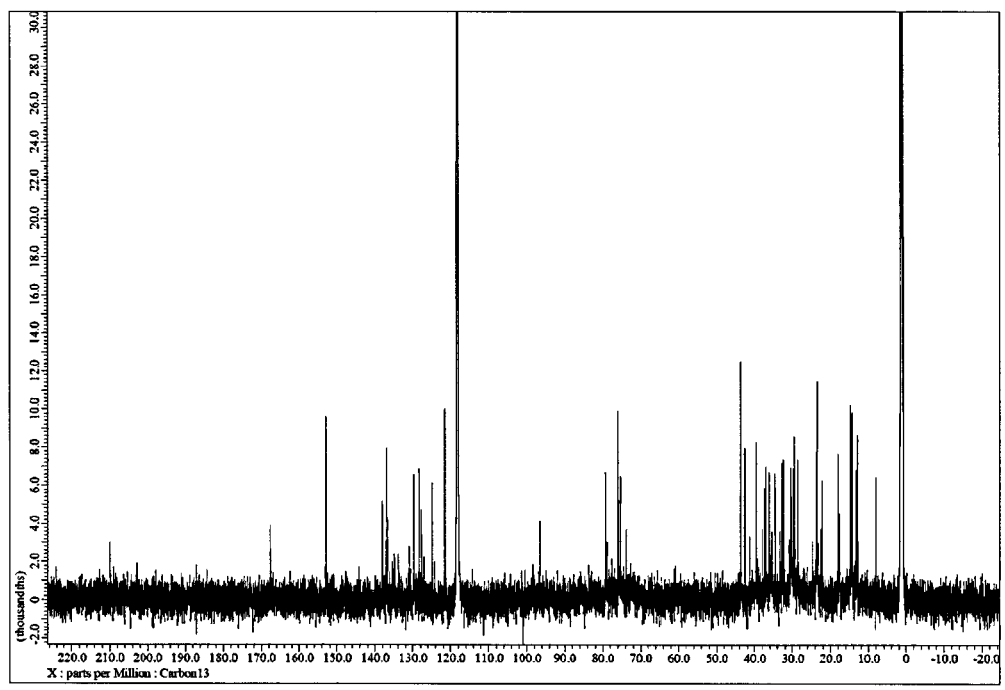

The amount of RMs (RM-A) produced by S. sp. SN-593 strain is normally about 12 mg L$^{-1}$ in an SY medium, the amount of RMs produced is 150 to 200 mg/L in high production medium (FIG. 5C). revQ gene disruption resulted in loss of ability to produce RMa (FIG. 5D) and complementation of revQ gene into the disruptant recovered production of RMs to a wild type strain level (FIG. 5E). From this, RevQ was found to be important in transcriptional control. Further, constitutive expression of revQ gene in a wild type strain increased the amount of RMs produced to about 1 g L$^{-1}$ (FIG. 5F).

3. Identification of Enzyme Forming Spiroketal Rings

Preparation of *Escherichia coli* Heterologous Expression Vector for revG Gene Using a template fosmid 11A02 containing revG gene, primers below, and PrimeSTAR HS DNA polymerase (TaKaRa), PCR was carried out at 98° C. for 10 seconds, followed by 25 cycles of reactions, each of which composed of 98° C. for 10 seconds, 62° C. for 5 seconds, and 68° C. for 1.5 minutes.

```
                                      (SEQ ID NO: 79)
5'-GGAATTCCATATGACGCGACGACTCGACGGTAAG-3'

(SEQ ID NO: 80)
5'-CCGCTCGAGTTACGGGGTGGTGAAGCCGGCGTC-3'
```

The obtained revG gene fragment of 822 by was digested with restriction enzymes (NdeI and XhoI) and then introduced into pET28b(+) (poly histidine fusion protein expression vector: Novagen) for use in *Escherichia coli* heterologous expression, thereby preparing pET28b(+)-revG.

Large Scale Expression of revG and Purification of Enzyme pET28b(+)-revG was introduced into *E. coli* BL21 Star (trademark) (DE3). The resultant was cultured in a TB medium (200 ml) containing kanamycin (50 μg ml$^{-1}$) at 28° C. until OD$_{600}$ reached 0.5 and 0.5 mM IPTG was added thereto for induction of gene expression. After culturing for 7 hours at 28° C., the *E. coli* was collected by centrifugation. The resulting pellet was then suspended in 20 ml buffer A (100 mM NaH$_2$PO$_4$ (pH 7.8), 500 mM NaCl, 5 mM imidazole, 10% glycerol) containing 0.5 mg lysozyme ml$^{-1}$ and 125 U benzonase and subjected to sonication to break up the suspension. After centrifugation, the supernatant was applied to Ni-NTA (2×2 cm) (Qiagen) column. The column was then washed with buffer A (50 ml) containing 0.2% Tween 20, buffer A (50 ml) containing 40 mM imidazole and then RevG (12 mg) was eluted with buffer A (25 ml) containing 250 mM imidazole. Subsequently, the eluent was dialyzed with buffer B (50 mM NaH$_2$PO$_4$ (pH 7.5), 100 mM NaCl, 1 mM DTT, 10% buffer) and concentrated using Amicon Ultracel 30K, thereby preparing purified enzyme RevG (7 mg ml$^{-1}$).

Analysis of Product of RevG Reaction

A reaction of enzyme forming spiroketal rings (RevG) was carried out under the following optimized conditions. A solution (100 μl) containing 50 mM glycine-NaOH (pH10), 1 mM DTT, 1 mM NAD+, 10% glycerol, 0.05 mM RM-A1a was kept at 30° C. for 5 minutes and a reaction was started with addition of 2.8 pmol purified enzyme (RevG). After incubation, 43 µl of acetonitrile was added to terminate the reaction. After centrifugation at 20,000×g, the supernatant was collected and a product of the reaction (20 µl) was analyzed by LC/ESI-MS.

Figures 6, 11:
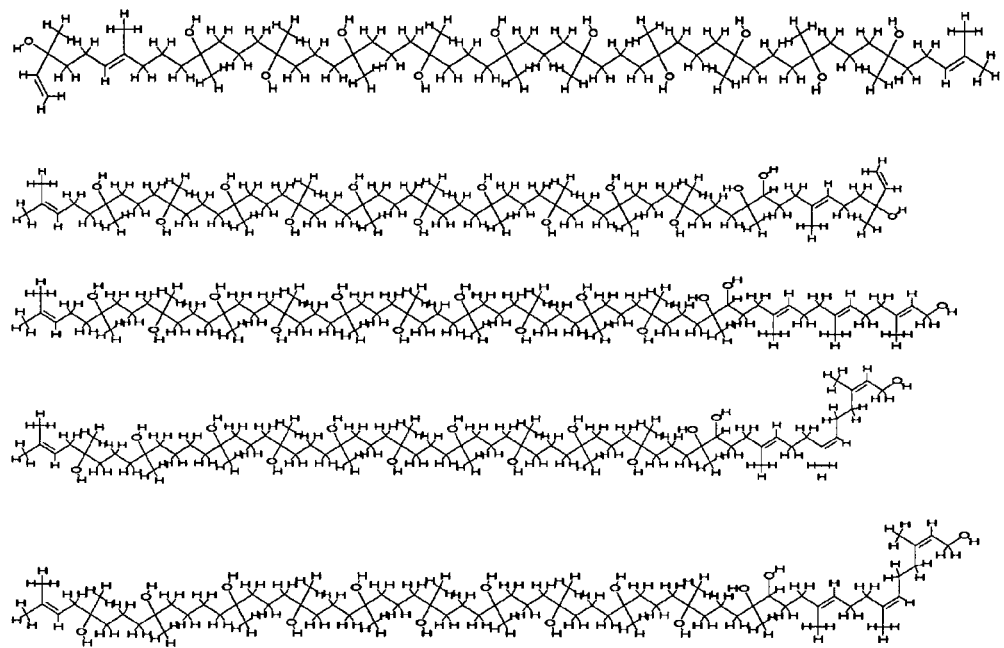

A product of the reaction was applied to Sep-Pak PLUS C18 column and washed with 30% acetonitrile, followed by elution with 100% acetonitrile, thereby obtaining the product of the reaction. As a result, as shown in FIGS. 6(a), (c), and (d), RM-A2a was generated in reaction one minute and RM-A3a and RM-A3b were generated reaction 10 minutes. From this, it was found that RM-A1a in an acyclic form was transformed into RM-A3a and RM-A3b having a spiroketal ring under an acidic HPLC condition via reaction intermediate RM-A2a and then an unstable intermediate C15-dehydro-RM-A2a.

FIGS. 7 to 10 show NMR charts of RM-A1a, RM-T, RM-A2a, RM-A3a and A3b.

4. Large Scale Expression of RevJ and Function Analysis (1) Preparation of *Escherichia coli* Heterologous Expression Vector for revJ Gene Using template fosmid 11A02 containing revJ gene, primers below, and PrimeSTAR HS DNA polymerase (TaKaRa), PCR was carried out at 98° C. for 10 seconds, followed by 25 cycles, each of which composed of 98° C. for 10 seconds, 62° C. for 5 seconds, and 68° C. for 1.5 minutes.

(SEQ ID NO: 81)
5'-GGAATTCCATATGGTGACCGAGACCGAACAGCTC-3'

(SEQ ID NO: 82)
5'-CCGCTCGAGTCAGACCCGGGTGAGGTCGAC-3'

The obtained revJ gene fragment was digested with restriction enzymes (NdeI and XhoI) and then introduced into pET28b(+) (poly histidine fusion protein expression vector: Novagen) for use in *Escherichia coli* heterologous expression, thereby preparing pET28b(+)-revJ.

(2) Large Scale Expression of RevJ and Purification of Enzyme pET28b(+)-revJ was introduced into *E. coli* BL21 Star (trademark) (DE3). The resultant was cultured in a TB medium (200 ml) containing kanamycin (50 µg ml$^{-1}$) at 28° C. until OD$_{600}$ reached 0.5 and 0.5 mM IPTG was added thereto for induction of gene expression. After culturing for 7 hours at 28° C., the *E. coli* was collected by centrifugation. The resulting pellet was then suspended in 20 ml buffer A (100 mM NaH$_2$PO$_4$ (pH 7.8), 500 mM NaCl, 5 mM imidazole, 10% glycerol) containing 0.5 mg lysozyme ml$^{-1}$ and 125 U benzonase and subjected to sonication to break up the suspension. After centrifugation, the supernatant was applied to Ni-NTA (2×2 cm) (Qiagen) column. The column was then washed with buffer A (50 ml) containing 0.2% Tween 20, buffer A (50 ml) containing 40 mM imidazole and then RevJ (12 mg) was eluted with buffer A (25 ml) containing 250 mM imidazole. Subsequently, the eluent was dialyzed with buffer B (50 mM NaH$_2$PO$_4$ (pH 7.5), 100 mM NaCl, 1 mM DTT, 10% buffer) and concentrated using Amicon Ultracel 30K, thereby preparing purified enzyme RevJ (7 mg ml$^{-1}$).

(3) Analysis of RevG RevJ Reaction Product

A coupling reaction of RevG and RevJ was carried out in the following procedure. A solution (100 µl) containing 50 mM Tris-HCl (pH 8.0), 1 mM DTT, 2 mM NAD$^+$, 1 mM NADPH, 50 µM FAD, 0.05 mM RM-A1a, 2.96 nmol purified RevG and 2.93 nmol purified RevJ was subjected to a reaction at 30° C. for 20 minutes. After centrifugation at 20,000×g, the supernatant was collected and a product of the reaction (10 µl) was analyzed by LCESI-MS in the presence (FIG. 6f) and absence (FIG. 6e) of 0.05% formic acid. As a result, because a 15S form that is consistent with the spiroacetal structure of a final biosynthetic product (reveromycin A) was solely generated only when RevJ was present and, RevJ was found to be a steric control factor.

5. Measurement of Growth-Inhibiting Activity Against Animal Cells

HL-60 cells (human acute promyelocytic leukemia cell line) and K562 cells (human chronic myeloid leukemia cell line) were maintained in a culture medium in which RPMI1640 medium (manufactured by Invitrogen) was added with 10% fetal bovine serum (manufactured by Nichirei), 0.5% penicillin/streptomycin solution (manufactured by Invitrogen) at 37° C. under a humidified culture of 5% CO$_2$. tsFT210 cells (mouse breast cancer cells CDC2 temperature sensitive strain) were maintained in a culture medium in which RPMI1640 medium (manufactured by Invitrogen) was added with 5% calf serum (manufactured by Hyclone) and 0.5% penicillin/streptomycin solution at 32° C. under a humidified culture of 5% CO$_2$.

HL-60 cells and K562 cells were seeded in a 96-well plate (manufactured by IWAKI) so as to be 1.5×10$^4$ cells/well/100 µl. tsFT210 cells were seeded in a 96-well plate so as to be 1.6×10$^4$ cell/well/100 µl. Each of the agents in Table 5 was added at 0.5% (v/v). HL-60 cells and K562 cells were maintained at 37° C. under a humidified culture of 5% CO$_2$ and tsFT210 cells were maintain at 32° C. under a humidified culture of 5% CO$_2$. Forty eight hours after addition of the agent, 10 µl of a reagent SF solution for counting live cells (WST-8 reagent, manufactured by Nakarai tesque) was added to each well. HL-60 cells and K562 cells were maintained at 37° C. under a humidified culture of 5% CO$_2$ for 30 minutes and tsFT210 cells were maintain at 32° C. under a humidified culture of 5% CO$_2$ for one hour. After the reaction, absorbance at 450 nm was measured using a microplate reader (manufactured by PerkinElmer) and a cell proliferation rate was determined from the measurement value.

6. Measurement of Growth-Inhibiting Activity Against *Escherichia coli*

*Escherichia coli* (HO141 strain) was precultured in culture medium of 0.5% Polypeptone, 0.5% Meat Extract, 0.3% NaCl, and 0.001% Sodium Dodecyl Sulfate (SDS) at 37° C. Absorbance at 600 nm was measured, and *Escherichia coli* solution was prepared such that the absorbance is 0.005 and seeded 100 µl each in a 96-well plate. Each of the agents in Table 5 was added at 0.5% (v/v) and maintained at 37° C. Six hours after addition of the agent, absorbance at 600 nm was measured using a microplate reader (manufactured by PerkinElmer) and a proliferation rate was determined from the measurement value.

7. Measurement of Growth-Inhibiting Activity Against Yeast

Budding yeast (MLC30M strain) was precultured in a culture medium of 2% Polypeptone, 1% yeast extract, 2% glucose, 0.02% adenine, and 0.001% sodium dodecyl sulfate (SDS) at 30° C. Absorbance at 600 nm was measured, and yeast solution was prepared such that the absorbance is 0.05 and seeded 100 µl each in a 96-well plate. Each of the agents in Table 5 was added at 0.5% (v/v) and maintained at 30° C. Eighteen hours after addition of the agent, absorbance at 600 nm was measured using a microplate reader (manufactured by PerkinElmer) and a proliferation rate was determined from the measurement value.

8. Measurement of Growth Inhibitory Activity Against Osteoclast

Bone marrow cells were harvested from thigh bone and shin bone of five-week male ddY mouse (manufactured by Japan SLC, Inc.), seeded in a type I collagen coated plate (manufactured by IWAKI) in a culture medium in which α-MEM medium (manufactured by Sigma-Aldrich) was added with 10% fetal bovine serum, 0.5% penicillin/streptomycin solution, 50 ng/ml human M-CSF (Leukoprol, manufactured by Kyowa Hakko), and 1 ng/ml human TGF-β1 (manufactured by R&D Systems), and maintained at 37° C. under a humidified culture of 5% $CO_2$ for 3 days. Cells were then washed twice with PBS and then cells adhered on the plate were used as bone marrow macrophage cells. Bone marrow macrophage cells were further maintained in a culture medium in which α-MEM medium was added with 10% fetal-bovine serum, 0.5% penicillin/streptomycin solution, 50 ng/ml human M-CSF, 50 ng/ml human soluble RANKL (manufactured by Peprotech) at 37° C. under a humidified culture of 5% $CO_2$ for 3 days to differentiate into osteoclasts.

Each of the agents in Table 5 was added to osteoclasts at 0.5% (v/v) and maintained at 37° C. under a humidified culture of 5% $CO_2$ for 24 hours. Subsequently, cells were treated with PBS solution containing 3.7% formalin at room temperature for 30 minutes. After the solution was removed, the cells were further treated with acetone/ethanol solution (1:1 vol/vol) at room temperature for one minute and the solution was removed to dry the cells. Immobilized cells were subjected to a reaction in TRAP solution [50 mM sodium tartrate, 90 mM sodium acetate, 0.01% naphthol AS-MX phosphate (manufactured by Sigma), 0.05% fast red violet LB salt (manufactured by Sigma), pH 5.0] at room temperature for 30 minutes and then washed with distilled water. The number of TRAP positive multinucleated osteoclasts was counted and a rate of survival was determined.

9. Measurement of Inhibitory Activity Against Isoleucyl tRNA Synthetase

To a solution for enzymatic reaction [20 mM imidazole, pH 7.5, 75 mM $MgCl_2$, 0.5 mM DTT, 1 U/ml tRNA (*E. coli* origin, manufactured by Sigma), 3 mM ATP, 1 μM isoleucine, 10 μCi/ml [$^3$H]isoleucine (manufactured by GE Healthcare), 10 μg protein (HT1080 cell lysate)], each of the agents in Table 5 was added at 1% (v/v) so as to attain a total amount of 100 μl and a reaction was carried out at 25° C. for 20 minutes. One mg/ml BSA solution (400 μl) and 10% TCA solution (500 μl) were then added thereto to terminate the reaction and left to stand at 4° C. overnight. A precipitate obtained by a centrifugal operation was transferred onto GF-C filter (manufactured by Whatman), washed three times with 5% TCA solution, followed by drying the filter. Two milliliters of aquasol-2 (manufactured by PerkinElmer) and the filter were placed in a vial and vigorously stirred, and then the amount of [$^3$H]isoleucine was measured by a liquid scintillation counter (manufactured by Beckman) to determine a rate of enzyme activity.

"Results and Discussion"

The results of the above 5 to 9 are summarized in Table 5. As a result, RM-T exhibited higher cancer cells growth-inhibiting activity and enzyme inhibiting activity against the target molecule IRS as compared with RM-A. From this, RM-T is expected to exert stronger anticancer effects than RM-A. In addition, RM-T methyl ester, RM-T ethyl ester, and RM-E exhibited a high cancer cell growth-inhibiting activity. Further, RM-T exhibited growth-inhibiting activity against yeast and it was found that it could be used as an antifungal agent. Furthermore, RM-E exhibited growth inhibiting actions against osteoclast and it was found that it could be used as a therapeutic agent for bone diseases.

TABLE 5

| Compound | | HL60* | K562* | tsFT210* | *E. coli** |
|---|---|---|---|---|---|
| RM-A1b | [structure] | 7.4 | 21.1 | 17.4 | 31.9 |
| RM-A1c | [structure] | 6.3 | 3.4 | 6.4 | >50 |
| RM-A2b | [structure] | >30 | >30 | >30 | >50 |

TABLE 5-continued

| Name | Structure | | | |
|---|---|---|---|---|
| RM-A1a | (structure) | 20.9 | >30 | >30 | >50 |
| RM-A1e | (structure) | >30 | >30 | >30 | >50 |
| RM-A8a | (structure) | 18.0 | 18.5 | 22.3 | >50 |
| RM-A6a | (structure) | 7.0 | 14.8 | 6.8 | 24.6 |
| RM-T | (structure) | 0.2 | 0.7 | 0.4 | >50 |
| RM-A9a | (structure) | 21.0 | 22.3 | 24.6 | >50 |
| RM-T methyl-ester | (structure) | 0.9 | 2.5 | 8.2 | >50 |
| RM-T ethyl-ester | (structure) | 0.2 | 0.7 | 11.4 | >50 |

TABLE 5-continued

| Compound | Structure | | | | |
|---|---|---|---|---|---|
| RM-A | (structure) | 2.7 | 4.9 | 8.5 | >50 |
| RM-E | (structure) | 1.5 | 1.9 | 7.0 | >50 |
| SF-A*** | (structure) | 1.2 | 3.4 | >30 | >50 |
| SF-B*** | (structure) | >30 | >30 | >30 | >50 |

| Compound | | Yeast* | OC* | IRS** |
|---|---|---|---|---|
| RM-A1b | (structure) | >50 | | |
| RM-A1c | (structure) | >50 | | 9600 |
| RM-A2b | (structure) | >50 | | |
| RM-A1a | (structure) | >50 | | |

TABLE 5-continued

| Name | Structure | Col1 | Col2 | Col3 |
|---|---|---|---|---|
| RM-A1e | (structure) | 48.2 | | |
| RM-A8a | (structure) | >50 | | |
| RM-A6a | (structure) | 31.5 | | |
| RM-T | (structure) | 0.05 | 6.2 | 0.2 |
| RM-A9a | (structure) | 26.4 | | |
| RM-T methylester | (structure) | >50 | | |
| RM-T ethylester | (structure) | >50 | 6.0 | 200 |
| RM-A | (structure) | 4.3 | 0.06 | 6.2 |

TABLE 5-continued

| Compound | Structure | Col3 | Col4 | Col5 |
|---|---|---|---|---|
| RM-E | (structure shown) | 2.3 | 0.10 | 2.8 |
| SF-A*** | (structure shown) | | | 0.3 |
| SF-B*** | (structure shown) | | | 4.0 |

*IC50 (μg/ml),
**IC50 (ng/ml),
***SF-A (spirofungin A) and SF-B (spirofungin B): Shumizu T. et al. Org. Lett. 2005, 7 (25), 5573-5576.

Each of the compounds in Table 5 was prepared as follows:

Preparation of RM-E

A wild type strain (*Streptomyces* sp. SN-593) was cultured in an SY medium for 2 days and 1 ml of preculture solution was inoculated in an RM-PM (70 ml) and cultured for another 5 days. To a total of 3 L of culture solution, an equal amount of acetone was added and stirred and then acetone was removed. The pH was adjusted to 4 with acetic acid and an equal amount of ethyl acetate was added and extraction was carried out twice.

Subsequently, a chloroform/methanol (10:1) fraction was collected by silica gel column chromatography, followed by $C_{18}$-HPLC (acetonitrile:0.05% formic acid=47:53) to purify 8.49 mg of RM-E.

Preparation of RM-A2b

A wild type strain (*Streptomyces* sp. SN-593) was cultured in an SY medium for 2 days and 200 ml of preculture solution was inoculated in an RM-PM (14 L) and cultured in a jar fermenter for 4 days. Subsequently, an equal amount of acetone was added and stirred, and then acetone was removed. The pH was adjusted to 4 with acetic acid and an equal amount of ethyl acetate was added and extraction was carried out twice. Following $C_{18}$-MPLC chromatography, elution was carried out with a 0.05% formic acid-acetonitrile 55-100% gradient using Pegasil ODS to purify 0.33 mg of RM-A2b.

Preparation of SF-A and SF-B

Synthesis was carried out according to Org. Lett. 2005, 7(25):5573-5576. Shimizu et al.

Preparation of RM-T Ethyl Ester and RM-T Methyl Ester

A wild type strain (*Streptomyces* sp. SN-593) was cultured in an SY medium for 2 days. Subsequently, 1 ml of preculture solution was inoculated in an RM-PM (70 ml) and cultured. After three days, ethanol was added thereto such that a final concentration thereof is 1% and cultured for another 2 days. To a total of 1.4 L of culture solution, an equal amount of acetone was added and stirred, and then acetone was removed. The pH was adjusted to 4 with acetic acid and an equal amount of ethyl acetate was added and extraction was carried out twice. Then, ethyl acetate was removed to obtain 1.2 g of crude fraction. Following silica gel column chromatography using hexane/ethyl acetate/acetic acid (100:100:1) solvent, $C_{18}$-HPLC purification was carried out to obtain RM-T ethyl ester. RM-T methyl ester was prepared in the same manner as above except that methanol instead of ethanol was added for culturing.

Preparation of RM-A8a

Large Scale Expression and Function Analysis of RevH (1) Preparation of *Escherichia coli* Heterologous Expression Vector for revH Gene In order to facilitate heterologous expression by *Escherichia coli*, revH gene was synthesized by optimizing a sequence thereof using artificial gene synthesis service by Operon Biotechnologies K.K. The sequence synthesized (including restriction enzyme sequences) is shown in SEQ ID NO: 99.

The synthesized revH gene fragment was digested with restriction enzymes (NdeI and XhoI) and then introduced into pET28b(+) (poly histidine fusion protein expression vector: Novagen) for use in *Escherichia coli* heterologous expression, thereby preparing pET28b(+)-revH.

(2) Large Scale Expression of RevH and Purification of Enzyme pET28b(+)-revH was introduced into *E. coli* BL21 Star (trademark) (DE3). The resultant was cultured in a TB medium (1l) containing kanamycin (50 μg $ml^{-1}$) at 37° C. until $OD_{600}$ reached 1.5, and 0.1 mM IPTG was added thereto for induction of gene expression. After culturing for 16 hours at 18° C., the *E. coli* was collected by centrifugation. The resulting pellet was then suspended in Lysis Buffer (Wash Buffer+1% Tween 20) and subjected to sonication to break up the suspension. After centrifugation, the supernatant was applied to Ni-NTA (2×2 cm) (Qiagen) column. The column was then washed with 50 mM Tris-HCl (pH 8.0), 0.1 M NaCl, 20 mM imidazole, 20% glycerol and then eluted with 50 mM Tris-HCl (pH 8.0), 0.1 M NaCl, 250 mM imidazole, 20% glycerol. Subsequently, the buffer was exchanged with 50 mM Tris-HCl (pH 8.0), 0.1 M NaCl using Amicon Ultracel 30K and then concentrated, thereby preparing a purified enzyme of RevH (5 mg $ml^{-1}$, 2 ml).

(3) Preparation of RM-A8a

RM-A8a was prepared by the following composition of reaction solution. A solution (30 ml) containing 50 mM Tris-HCl (pH 8.0), 0.5 mM DTT, 1 mM NAD$^+$, 0.7 mM NADPH, 0.1 mM FAD, 0.04 mM RM-A1a, 100 nmol purified RevG and 31 nmol purified RevH was subjected to a reaction at 30° C. for 150 minutes. Next, 20 nmol purified RevJ was added thereto and a reaction was performed at 30° C. for 120 minutes. After completion of the reaction, the reaction solution was extracted twice with an equal amount of ethyl acetate and dehydrated with sodium sulfate, followed by evaporation of ethyl acetate by an evaporator. Residues were dissolved in methanol and subjected to HPLC (column: PEGASIL ODS (20 mm×250 mm, Senshu Kagaku) for fractionation. Elution was carried out with 85% acetonitrile at a flow rate of 8 ml min$^{-1}$ and elution time was 25 minutes. Further, acetonitrile/water were evaporated by an evaporator, thereby obtaining about 0.3 mg of RM-A8a.

(4) Preparation of RM-A6a and RM-A9a

Figure 14:
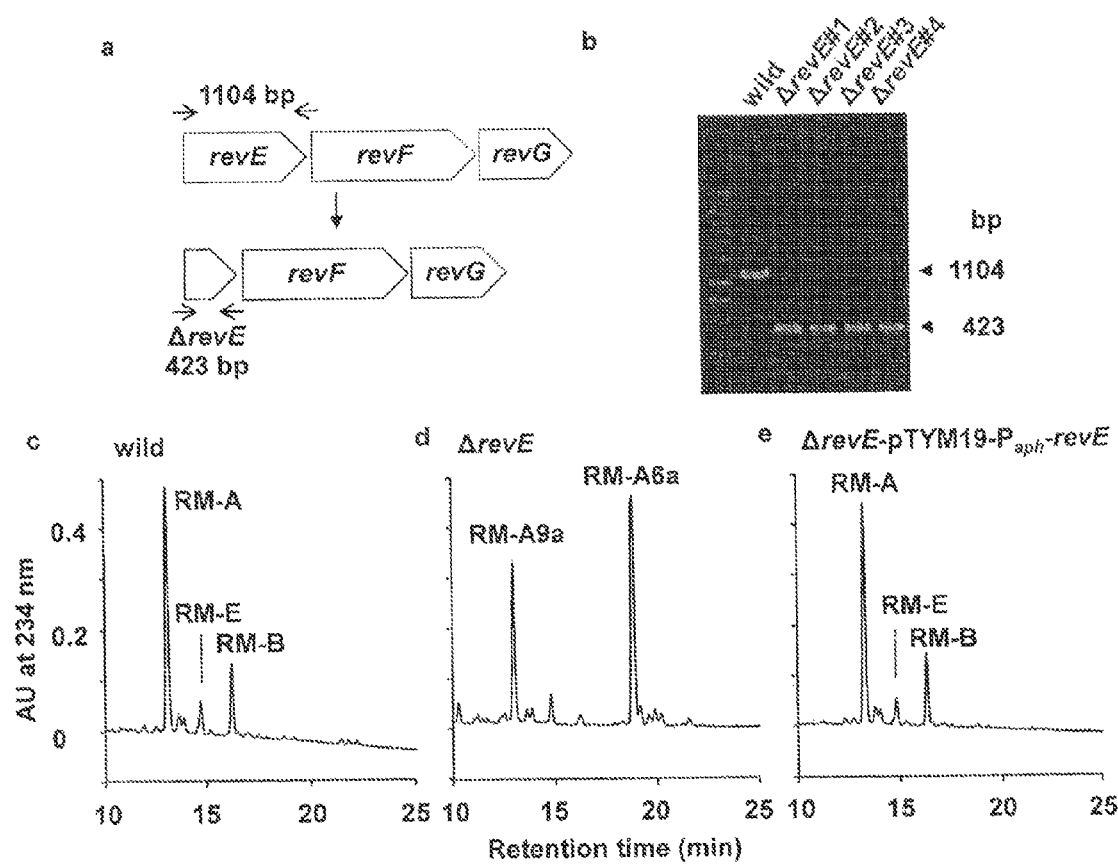
FIG. 14 shows revE gene disruption and metabolite analysis. (a) A scheme for revE disruption and a PCR analysis map of wild type and ΔrevE. (b) A photograph of electrophoresis. Arrows show the expected size of amplified fragments (bp). Wild type (lane 2) and ΔrevE (lanes 3, 4, 5 and 6). (c) LC-MS analysis of reveromycin compound from culture extract of a wild type strain. (d) LC-MS analysis of reveromycin compound from culture extract of a/the ΔrevE strain. (e) LC-MS analysis of reveromycin compound from culture extract of a strain obtained by complementing a ΔrevE strain with pTYM19-P$_{aph}$-revE.

RM-A6a and RM-A9a are produced by a revE disruptant (FIG. 14).

A revE gene disruptant was cultured in an SY medium for 2 days. One milliliter of preculture solution was inoculated in an RM-PM (70 ml) and main culture was carried out for 5 days. To a total of 5 L of culture solution, an equal amount of acetone was added. Extraction of metabolites, removal of acetone, and adjustment of the pH to 4 with acetic acid were carried out. An equal amount of ethyl acetate was then added and extraction was carried out three times, and ethyl acetate was removed to obtain 3 g of crude fraction. Subsequently, a chloroform/methanol (10:5) fraction was collected by silica gel column chromatography and then $C_{18}$-HPLC (acetonitrile: 0.05% formic acid=60:40) purification was carried out. Further, $C_{18}$-HPLC (acetonitrile: 0.05% formic acid=75:25) was carried out to purify 6.9 mg of RM-A6a. From the same crude fraction as RM-A6a, a chloroform/methanol (10:5) fraction was collected by silica gel column chromatography and $C_{18}$-HPLC (acetonitrile:0.05% formic acid=60:40) purification was carried out to obtain 130 mg of fraction containing RM-A9a. This was further subjected to elution with a $C_{18}$-HPLC (0.05% formic acid-acetonitrile 60-100% gradient and $C_{18}$-HPLC (acetonitrile:0.05% formic acid=52:48) purification to purify 18 mg of RM-A9a.

INDUSTRIAL APPLICABILITY

The present invention is useful in the fields of substance production and pharmaceutical.

Specific embodiments of the present invention were described in detail above, but it will be apparent to those skilled in the art that these embodiments are not restrictive but illustrative. In addition, each patent, patent application and publication referred in the present description and the disclosures of Japanese Patent Application No. 2010-194222 from which the present application claims priority is incorporated herein by reference in its entirety.

SEQUENCE LISTING (99 sequences)

SEQ ID NO: 1 - DNA, 18855 bp, Streptomyces sp. SN-593
  CDS (1)..(18852)
atggaccacgaattctccgactcggacgtcgccgtcatcggaatggcgtgccgcctcccgcaggcaccggaccccgccggcttctggcggctgctgcgcaccggcaccagcgccgtcggcgaggtccccgcggaccgctggcccgaccggcccggcaacgacggccacgacgacgccctgcgggccctcgtccgccgcggcgccttcatcgacgcgccggacgccttcgacgcggccttcttcggcgtctcgccgcgcgagagcgccgagatggacccccagcagcgcctggccctcgaactcggctgggaggcactggaggacgccggcgtcgtccccgagacgctgcgcggcctgccggtgggcgtctacgtcggagcgatggccagcgaccacgcccacctgacctccctgcgcagcccccaggcgctcaaccaccacaccatggccggcacgcaccgggccgtcatcgccaaccgcatctcgtacttcgcgggactgcgcgggccgagcatgaccgtcgacaccggccagtcctcctccctcgtcgcggtccacatggcctgcgaggcgctgcgcaccggagaggcgcggctcgccctcgccggcggcgtcaacctcaacctcaccgagcagacggccctcctggaggcccggctcggcgcgctgtcccccgacggaaggtgcttcaccttcgacgagcgggccaacggctacgtccgcggcgagggcggcggcttcgtcgtcctcaagcccctccgggacgcgctggccgacggcgacgacgtctactgcgtcatccgcggcagcgccgtcaacaacgacggcgccggcgacagcctgctggtgccgaccgtgaccggccagcgcgaggtgctcacccgcgcctacgaccgggccggcatcgcccccggcgcggtgcagtacgtcgaactgcacggaaccggaaccaaggtcggcgacccggtcgaggccgaggccctcggccatgccctcggcaccgaccccgaccgcgaacaccccctgctcgtcggctccgtgaagaccaacgtcggccacctggaaggcgccgccggcatcaccggcctgctcaaggtcgccctcatgctcaagcaccgccggatcccggccagcctgaacttccgacggctcaaccccgacatccgcgccgacgagtggaacctgcgggtcgccgccgaacccggtccgtggccggagcccgcgggcacgctgcacgccggcgtgtcctcgttcggcatgggcggcaccaactgccacgtcgtgctcagctccccggtgcgggccgaggccccgcccgcccccgagaccgcccccggccccgcggccgacgcgcaccccggccccgccgaactcgccctcgtcgtgtccgccaagtccccggcggccctgcgcgcccaggccgaactgctgctggaccggatggccgccgaccccgcgccggaccccgccgatgtcgcctggtcgctggtcggctcgcgctccgccttcccccaccgcgccgtcgtcgtcggccgcgaagcgcaggagctgaccaccggactcgccgccctggccgcgggcgagcccgccgccggactcgtccagggccacgcgcggcccgaccaccgggtggcgttcgtcttccccggccagggcgcccagtggaccggcatggcgaccgggctgatggcggactcaccggtcttccgcgcggcgatcgaggagtgcgcccaggcgctgcgcccctacgtcgactggtcgctcaccgacgtcctcgacgaccgggccgccctcgaacgcgtcgacgtggtccaacccgcgctgtgggccgtcatggtctccctcgcccgactgtggcgctggatgggcgtcgaacccgccgccgtcgtggggcactcccagggcgagatcgccgccgcctgcgtcgccggcggcctgtccctggacgacggcgcccgcgtggtggccctgcgcagccaggccatcgcccagaccctcaccggccgcggcggcatggccgtcgtggcactgcccgcccccgaggccgcggacctcatcgccccctgggacggccggctgtccatcgccacggtcaacggccccggctcggtcgtcgtgtccggcgagtccgcggccgtcggggaactggcggcgcggtgcgcggacaccgggatccgggtccgcccggtctccgtggactacgcctcgcactccgcggccgtcgaggagatcgaggaccggctgctcgccgacctggcaccgctgcgcccgcgcgcgggcacggtgccgatgtactcctccgtgaccggcgcccccgtggacaccacggaactcgacgcccgctactggtaccgcaacctccggcagacggtgcggttcgagaccgccacccgcgcgctcgccgccgacgggatatcggtcctggtcgaggtcagcccgcacccggtgctcaccgtgccggtccaggacaccctggactccctcggcgaggcggacggccaggacggcgcggccggtcccgacggccgcaccggacccggcggccccgacgcggccgcgggccgcacggccgtcgtcaccggcagcctgcgccgcgaccagggcggcctggaccgcttcctcacctcggtcgcccaggtccacgtgcacggcgtgcccgtcgcgtgggccgccctcttcgagggctcgcggccgcggcggatcaagctgcccacgtacgccttccagcgcgaccggcactccgtcatcggcctcggccaggagcccgtccggctcctggaggccgatgccggcgccacgcccgggctcgcgcccgccaccggcgaccaggacgacgcgttcctcggcaagctggccccgatgtccgccaaggagcgcgacgcccacctgctctcggtggtccgcgaccacgccgccgccctgctcggccaccgcggcggtgccgacgtggaccccaccgtgcccttccggtcggcggggttcgactcgatgaccgcggtcgacctgcgcaaccggttgcagagcgccaccggcctgcccatcccgagcagcatggtgttcgactaccccacgcccgcccgcctcgcggccttcctggccggccggctcggcggcacccggtccgccgacgacaccgcgctcccgctgcccgccgccccggtcgccgacgatccgctggtcatcgtgggcatgtcctgccgcttccccggcggcgtcgccggccccgagcagatgtgggacctcgtcatcggtgagcgcgacgcgatcaccggcttcccgaccgaccgcgactgggacctggaacacctctacggccccgacaccgcgggccgcctggccggcgggttcgtggagggggcgttggacttcgatgcggggttcttcgcgatgtcgccgcgtgaggcgttggcgacggatcctcagcagcggttgttgttggaggggtcgtgggaggcgttggagcatgcggggattgatccggtgtcgttggcgggttcggcgacgggggtgttcgtcggcagttaccagtccggttatgcggaggtggtgtcggcggcgttggtggatgcggatgcggatgcgcagttgttgacgggtggtgcgcagagtgtgttgtcggggcgggtggcgtatgcgttggggttggtgggtccggcggtgacggtggacacggcgtgttcgtcgtctttggtggcgttgcatttggcgggtcaggcgttgcggggtggggagtgctcgctggcgttggtggcgggtgtgacggtgaatgcgttgccgcacacgtttgtggggttctcgcagcagggtgggttgtcggctgatggtcggtgcaaggcgttcgcggaggcggcggacgggacgggtttcagtgaggggatgggggtgttggttgtcgagcgtttgtctgatgcggagcggaacgggcatcgggtgttggcggtggtgcggtcgagtgcggtgaaccaggacggtgcgtcgaacgggttgacggcgccgaacggtccgtcgcagcagcgggtgatccggcaggcgctggcggctgcggggttgtcgtcgggggatgtggatgtggtggaggggcatggcacgggcacgacgttgggcgacccgatcgaggctcaggcggtgttggcgacctacggccaggatcggtcggaggagcggccgttgttgttggggtcgttgaagtcgaacatcggtcatacgcaggcggctgcgggtgtggcgggtgtgatcaagatggtgttggcgatgcggcatggggtggtgccgcggacgttgcatgtggatgagccgtcgtcgcatgtggactggggccagggtcgggtgcggttgctgacggagtcggtggcatggccggagagcggtcgtccgcggcgggcgggtgtgtcgtcgttcgggatctcggggacgaacgcgcacgtgatcttggaggcggctcccgcggtggagtccgaggtcgaggtggaggtcgcgggaggggctggggccgagcacgcctccgagacggtgtgggtggtgtcgggtcgttcggagggggcgttgcgggcgcaggcggagcggctgttgtcggtggccgaggggctggatccggtggatgtgggtggggcgttgttgtcgcggtcggtgttcgagcaccgtgcggtggtggtgggcagtgggcgtgaggaactgacggcggggttgcgggcgttggcggccggtgaggcggcggggaacgcggtggagggtgtggcgcggagtggtcgtcgggtggcggtgttgttcgcgggtcagggtgcgcagcggctggggatgggccgccggctgcacgaggagtcgtcggtgttcgcggcggctttcgacgaggtggtggcggagttggaccggcacctcgacgttccgttgcgggaggtggtgtggggtgaggacgcggaggcgttgaactcgacgggttgggcgcagccggcgttgttcgccgtcgaggtggcgctgttccggctgctcgaatcctttggcgtcacaccggattacctgctggggcactccattggtgaggtggctgcggcttacgtcgccggggtgtttgatctggtggatgcgtgtcggttggtgggggcgcgggcgcgtttgatgcaggcgcttccggtgggtggggcgatggtggcggttgccgcgccggaggaggaggtgctgccgcatctgtcggacggggtgtcggtggcggcggtgaacgcgccgggttcggtggtggtctccggtgaggagtccgctgtgctcgcggtcggtgagcatttcaaggcgttgggggtgaagacgactcggctgcgcgtctcgcacgccttccattcggcgttgatggagccgatggtggacgacttcctggcggcgatcgcggatgtgtcgttctcggagccgcggattgcggtggtgtcgaatctgacgggtgagccggcggatatgacgtcgccgaagtactgggcgcagcaggtgcgttcgggggtgcggttcgcggacggtgtggcgtggttgacggcgcagggtgtggacgtgttcgtggatgcgggtcctgatggtgtggtggcgggtctggcgcaggccaacgcgtcggatgcggtggcggtggcgttgatgcgcaaggatcgtggtgatgtgcggacggtgttccacgcggtggggcagttgttcgtggagggtgtgccggtcgggtgggagacgttgttcgccggtgcggggccccgtcgggtggatctgccgacgtatgcgttccagcgccgccgttactggccgcaggcgtccctcgcgggcggcgacgtgatcgccgccggtctggcgtccgccgagcacccgttgctgagcgcggtggtgtcggtgcccggttcgggtgccgtcgtgctgacctcgcggctctcggcacgtacacagccgtggctggccggccacgccgtccaggggacggtggtcttccccggtgccggtctcgtggagctggcgatccgcggcgcggacgccgtgggcgcgggcgggctgcgggagttggaggtggaagccccgctggtcgttccggagaccgcgagcgtccaggtccaggtcgtcgtggcggacggccggctggagatctactcgcgcgccaccgacgacgacccgtggacccggcacgcgaccgccgtgctcggtgacgccctcgccgccggggcggccgactggccgtggccgcccgccgcggactcgcgcgtggacctccccgacctctccgaggcgaccgacggtgacggtctcgcggacggcccggccctccaggggctgcggcaggtctggcaggccgacggcgaggtcttcgccgaggtggccgtggcagagaacgaggccgaccgggcgcgcaagttcggcgttcacccggacctgctggaggcggccctccgggcgagcgccttcgcggagccggaccccgtcccggccgggcgggtgtggaccggcttcgccgacgtgaccctgcacgccgagggcgcgacggcggcacgcgcccgggtggtccgtacgggcccggaccgcgtgagcgtggaactcttcgacggcaacggcgagccggtgctgtccatcggctccgtgacgctgggcgcggctcccgcctccggacccttggccgcctcccggaacgggacggcgctggccctcgactggccggcgctgcccgcggcggagaccggcgcggactccgccgagggcgcgggagttccggacggagtggacgctccgggcggcccggcgttcgcgttcgtccaggcgcccacggccgacccttcgtggctgccggaaccggcgtacccgcacctcgacggcgtcctcgccgacggcaacccgccgcggtacgtggtgctcgccgtgtcgggcggggcgcccgacgacatggtgcgggccgtgcacgccacgacgcggtgggccctggagcagcttcagtcctggctggccgaggagcgcttcgccgacaccaccctggtcgcgctcacccgcggcgcggtctccgcgggccacgacgagcccgtgccggacctcggcgcggccgcggtgtgggggctgctgcgcaccgcgcagagggagcacccgggccgggtcgtcctcgtggacacggagcccggcatcgacctcgacgtccggcggctggcgctggcgctgcgcggcggcgagccgcaactcgccctgcgcggcgaggagatccgcgcggcgcggctggtccgcgtcaccgcgcaggacgcacccgaggcgcgcccggagcccgagggcacggtgctggtcacgggcggtacgggtggtctgggccgtgaggtggcgcgtcacctggtggcggtgcacggggtgcggagtctgctgctgctgagtcgtcggggtctggcggccgagggtgcgcgggagttggtcgaggagttgggcgcgctgggcgcggaggtcgtggtcggggcgtgtgacgtcgcggatcgtgcggcgctggcggaggtgctcgcgggtgtgcggctgacgggtgtggtgcacacggccggtgtggtggacgacggtctggtgtcgtcgttgaccgctgaacgcctggaccgggtgctcgtgcccaaggtggacgcggcctggcacctgcacgagctgaccgccggggcggacctggcgttcttcgccgtgttctcctcgctgtccggcatcctcggcaaccccggtcaggccaactacgcggccggcaacgtcttcctcgacgcgctgatgcaggcccggcgccacgccggtctgcccggcgtctcgatggcctggggcgcctggacgcaggacgtgggcctgaccgccgcgctcaccgaggccgacatgcgccggctggcccgctcgggcatgcggccgctgtcggtgccggagggcctggccctcttcgaccgcgctctcgcgtccgaccgggcactcctcggactcgccagcctggacctcgccgccctccgggcccgcgacgacctgcccgtcttccgttcgctggcgggcggccgggcccggcgccgggccggggagcagcagctcgccggcggcctggccgagcggatggcccggctgaccgagccggaacgcgaggacttcctcctcaccctcatccgcgaccacgcggcggccgtcctcggccacgcgtcgggccagcacctgaacgtcaccacggcgttccgggagatgggcttcgactcgctgatgggcgtcgaactgcgcaaccgcgtcaagcgcggcaccggcctgccggtggcggactcgatggtctacgactacccgacgccgctgcggctcgcccagtacctggcgagcctgatgggcggcgtcgaggtccgggcgggcggtgccacgccggcccgcgcgctcgccgacgacgaccgactggcgatcgtgggcatggcctgccgcttccccggcggggtcaccaaccccgacgagctgtggaagctcatcgccgagggcggcgacgccatcgccgggttccccgacgaccgcggctgggacgtcgagcagctctacgacgcggagggcacccggagcggaagctccgtcacccgcagcggcgggttcgtcgaggccgacgggttcgacagcgccttcttcggcatctcgccccgcgaggccctggcgatggacccccagcagcggctgctgctggagagctcgtgggaggcgctggaggacgcggggatcgacccgcagtccctggccggcagctccaccgcggtcgtgttcggcatcagccagtcgcactacggcgagctggtcaggccgctggaggagacccagggccacctgctgaccggcggcgccttcagcgtcgcgtccggccgggtggcgtacacgctgggtctcgaaggccccgcggtgacggtggacacggcctgctcgtcgtccctggtggcactgcacctggccgggcaggcactgcgggccggcgagtgctcgatggcgctggccggcggtgtgacggtgatggcgacgccgggcaccttcgtggagttcagccggcagggcggtctgtcggccgacggccggtgcagggcgttcgcggacggtgcggacggcaccggctggtccgagggcgtcggtgtgctggtggtggagcggttgtcggacgcggagcgcaacgggcaccgggtgctggcggtcgtacgtgccagcgcggtgaaccaggacggcgcgtcgaacggcttgacggcgccgaacggtccgtcccaacagcgggtgatccggcaggcgttggcggcggccgggctcaactccggtgacgtggacgccgtggaggcgcacggcacgggcacccggctcggcgaccccatcgaggcgcaggcgctgctgtccacgtacggccaggaccggccggaggaacggcccttgtggctggggtcgttgaagtcgaacatcggtcatacgcaggcggcggcgggtgtcgcgggcgtgatcaagatggtgctggcgatgcggcacggggtgctgccgcagacgttgcacgtggacgagccgagttcgcgcgtggactgggaccagggtcgggtgcggttgctgacggagtcggtggcctggccggagagcggtcgcccgcggcgggcgggcgtgtcgtcgttcgggatgtcggggacgaacgcgcacgtgatcctggaggccccggcgaccccggagcccccggcgggcgcggcggtcccggccgggatcgagcccggcaccgcggcggacgccgatccgcaacagggcgccgtttcgccggccgtgggatgggtgctctccgcccgctccgaggacgggctacggggtcaggcgggtcgtctgctggcggctgtggagtcgtccgggtcggcgggttcggtggagccggtggatgtgggtgcggcgttgttgtcgcgttcgctgttcgaccaccgggcggtggtggtgggtgcggatcgtgagcaactggtgtcgggtgtgcgggcgttggcggcgggtgagccggccgggaacctggtgggcggcgctgccggcggtggtcaggagcgtcgggtggtgttcgtcttcccggggcagggtgcgcagtgggtgggtatggcggagggtctgctgaattcctcgtcggtgttccgggagtcgatggagttgtgtggggaggcgttgaggccttttgtggagtgggatttgttgggggtgttgggtgagggggatgaggtggtgttggggcgggttgatgtggtgcagccggtgttgtgggcggtgatggtgtcgttggctgcggtgtggcgttcgtggggtgtggtgccggctgcggtggtggggcattcgcagggggagattgcggcggcgtgtgtggcggggggtttgtcgttgggtgatggtgcgcgggtggtggcgttgcggagtcgggcgattgcgggggcgttggcgggtaggggtgggatggtggcggtgtcgttgccggtggagggtgtgcgggggttgttgtcggggggtttgtcggtggcggtggtgaacagtcctggtggtgtggtggtggcgggtccggtggaggagttggatgcgttgttggtggtgtgtgaggagcggggggtgcgggcgcgtcgggtgccggtggattatgcgtcgcattcggtgtttgtggagttgatcgaggatcgggtgttggcggatttggcggggttggcgccggtgtcgggttcggtgccgatgtattcgtcggtgtcgggtgagcgggtggatacggcgggtttggatggggggtattggtatcggaatttgcggcagacggtggagttcgagcgggcgacgcgggcgttggcggcggatggtttctcggtgtttgttgaggtgagtccgcatccggtgttgacggtggcggtgcaggacacgttgggtgagggtgtggtggcggcgggtacgttgcgtcgtcatgagggtgggttggaccggttcctgttgtcggccgcggagctgttcgtgcacggcgtccccgtgacgtggaacggtctgttcgcggaccggaagccgcggccggtgagcctgccgacgtacgccttccagcaccagcggtactggccgcagccttcgttggtggcgggggacgtggcggctgcgggtctggtgtcggcggagcatccgttgctgggtgccgtggtgtcggtgcccggctcggacaccgtggtgttgacgtcgcggttgtcgttgcgggcgcagccgtggttgggggaccacgcggtgcacgggacggtgatcttcccggggacggggttcgtggagctggcgatccgcggtgcggacgccgccggcgcgggccggcttcgggagctgatcgtggaggcgccgctggccgttccggccggcggaagcgtccaggtccaggtggtcgccgacgccgaggaccacaccgtcgccgtctacgcccgagccgacgaggacgagccgtggacccggcacgcgatcggcgccgtcgacgacgagacagcgggcgtggacaccgcggacctggccggggagtggccgccggcgggcagcacgccggtggacctggaggacttctaccagcgcagcgccgacagcgggttcggctacggcccggtcttccagggcctgacccgggcatggcgcctcgacggccgtatctacgccgaggccgccctgcccgacgaccaggcggccgccgcaacggcgttcggcatccacccggcgctgctggacgcggccctgcacccgaacaccttcgccgacctcgaacccaccgaactcggccggctgcccttcacgttcgacgacgtcaccctgcacgccaccggcgcgagggccgtacggatacggatggcgcgcacgggaccggactccgtcacggccgtcctggccgacgagaccggcgcgcccgtcctgtcgatcggctcgctggtcatgcgtccggtcccggagcaggtcctcggcggggcccgggccccggagacgatgctcgccctggtctggaacgaggtgccggacgcgtccggtgcggcggccggcgcggagcccggtgcggcgcccgcccaggacggcgacgtgctgctggaggtacccgccgcggccgacggttcaccggagtcggtgcacgcggccgtggcgtggacactcgggcagttgcagggcctcagcggcggccgactggtcgtcctgacccgcggcgcggtcgccgccctgcccggcgagaccgtcaccgacctggccgcggccgccgtgtggggcctggtgcggtccgcgcagagcgaggacccgggccggatcgtcctggtcgacgccgacgagggcacgcgggccacccgcgacctgctggcgcgcgtggccggcaccggcgagccgcagctcgcggtgcgtgaaggcgccctgctggcaccccagttgacgcgcacgaccgagaccggcgagcccgtcgccctggacggcaccgtcctgatcaccggcggaaccggcggcctcggcagcgcggtcgcccggcacctggtcgccgcgtacggcgtgcgcagcctcctgctgctcagccgccggggcggcacggcccccggcgccgccgaactcgtcgaggagctgaccgcccagggcgccgaggtcacggtggtcgcgtgcgacgccgccgaccggtcggccctggccgaggtgctggcgggagtgccgctcgcgggagtggtgcacaccgcgggcatcctggacgacggcgtgatctccacgctcaccccggagcaggtccaccgcgtgctgaccccgaaggtcgacgccgcctggcacctgcacgacctgacccgcgaccgcgacctcgcgatgttcgtggtgttctcctcgctcgccggactcatcggcagcccgggacagggcaactacgccgcgggcaacgtctacctcgactccctcgtgcagcagcgccgcgccgccggactcgccggcatctccatggcatggggaccgtgggaccagagcctgggcctcaccggcgcgctgtccggcaccgacatgcaccgcctgggccggctcggcatgctcccgatctcggaggagcaggggatggccctgttcgaccaggcgctctccgccggcctgcccctgctgggactgaccgaactgaaggcatcggccctgcgggccacgaccgaggtcccggcgctgttccggtcgctcgccggcggcccggcgcgccggacccgggcccgcgcgggagccgcggcgccggcggccggccttgccggcaggctggccggtctgacccccgagcagcggcagagccacctgctcggcctggtccgcgagcacgccgccgcggtgctggggcacggctccggcagccggatcgccgcggagcagcccttccgcgaggtgggcttcgactcgctgaccgcggtcgagctgcgcaaccggttgcaggccgtgacggagctgagcctgccgtcgacgctcgtcttcgactacccgaacgcggtgcgtctcgccgggtacgtgggcgagcgcctgggcggcgtcaccgccgctccggtcgacgcgctgccggtgctgcggtcggtcgacgacgatccgctggtcatcgtgggcatgtcctgccgcttccccggcggcgcttcggacccggaccggttgtgggacctgctggagcagggccgggacggcatgggcgcgttccccggcgaccgcggctgggacaccggcctgctgacggagctggcccacgcgggcgggttcgtggagggggcgttggacttcgatgcggggttcttcgcgatgtcgccgcgtgaggcgttggcgacggatcctcagcagcggttgttgttggaggggtcgtgggaggcgttggagcatgcggggattgatccggtgtcgttggcgggttcggcgacgggggtgttcgtcggtagttaccagtccggttatgcggaggtggtgtcggcggcgttggtggatgcggatgcggatgcgcagttgttgacgggtggtgcgcagagtgtgttgtcggggcgggtggcgtatgcgttggggttggtgggtccggcggtgacggtggacacggcgtgttcgtcgtctttggtggcgttgcatttggcgggtcaggcgttgcggggtggggagtgctcgctggcgttggtggcgggggtgacggtgaatgcgttgccgcacacgtttgtggggttctcgcagcagggtgggttgtcggctgatggtcggtgcaaggcgttcgcggaggcggcggacgggacgggtttcagtgaggggatgggggtgttggttgtcgagcggttgtctgatgcggagcggaacgggcatcgggtgttggcggtggtgcggtcgagtgcggtgaaccaggacggtgcgtcgaacgggttgacggcgccgaacggtccgtcgcagcagcgggtgatccgccaggcgctggcggctgcggggttgtcgtcgggggatgtggatgtggtggaggggcatggcacgggcacgacgctgggcgacccgatcgaggctcaggcggtgctggcgacctacggccaggatcggtcggaggagcggccgttgttgttggggtcgttgaagtcgaacatcggtcatacgcaggcggctgcgggtgtggcgggtgtgatcaagatggtgttggcgatgcggcatggggtggtgccgcggacgttgcatgtggatgagccgtcgtcgcatgtggactggggccagggtcgggtgcggttgctgacggagtcggtggcttggccggagagcggtcgtccgcggcgggcgggtgtgtcgtcgttcgggatctcggggacgaacgcgcacgtgatcttggaggcggcgcctggggtggaggccgaggtcgaggtcgtggaaggggatggggccgagtccgggtccgagtccgggtcggggtcggtgtgggtggtgtcgggtcgttcggagggggcgttgcgggcgcaggcggagcggctgttgtcggcggtgtcggaggcggagtcgtggggctcggcggcggtgggtgcggcgttgttgtcgcggtcggtgttcgaccatcgtgcggtggtggtgggtgcggatcgggctgaactcgtggcaggtttgggggcgttggcgtcgggggagccgggtgctctggtggcgcagggtgtggcgcggagtggtcgtcgggtggcggtgttgttcgcgggtcagggtgcgcagcggctggggatgggccgccggctgcacgaggagtcgccggtgttcgcggcggccttcgacgaggtggtggcggagttggaccggcacctcgaggcgccgttgcgggaggtgctgtggggcgaggacgccgaggcgttgaactccaccggttgggcgcagccggcgttgttcgcggtcgaggtggcgctgttccggctgttggagtcgttcggcgtcacaccggattacctgttggggcactccatcggtgaggtggcggccgcgcatgtggccggggtgttcgatctggtggatgcgtgtcggttggtgggggcgcgggcgcgtttgatgcaggcgcttccggtgggtggggcgatggtggcggttgccgcgccggaggaggaggtgctgccgcatctgtcggacggggtgtcggtggcggcggtgaacgcgccgggttcggtggtggtctccggtgaggagggcgcggtcttggaggtcggtgagcacttcaaggcgctgggggtgaagacgacccggctgcgtgtctcgcacgccttccactcggcgttgatggagccgatggtggacgacttcctggcggcgatcgcggatgtgtcgttctccgagccgcggattgcggtggtgtcgaatctgacgggtgagccggcggatatgacgtcgccgaagtactgggcgcagcaggtgcgttcgggggtgcggttcgcggacggtgtggcgtggttgacggcgcagggtgtggacgtgttcgtggatgcgggtcctgatggtgtggtggcgggtctggcgcaggccaacgcgtcggatgcggtggcggtggcgttgatgcgcaaggaccgtggtgatgtgcggacggtgttccacgcggtggggcagttgttcgtggagggtgtgccggtcgcgtgggagacgttgttcgccggtgcggggtcccgtcgggtggatctgccgacgtatgcgttccagcgccgccgttactggccgcaggcgtccctcgcgggcggtgatgtggcggctgcgggtctggtgtcggcggagcatccgttgctgggtgcggtggtgtcggtgccggagtcggggacggtggtgttgacgtcgcggttgtcgttgcgggcgcagccgtggttgggggatcacgcggtgcacgggacggtggtcttcccgggggcggggttcgtggagttggcgatccgcggtgcggatgcggtgggtgcgggtggtctgcgggagttggtcgtggaggcgccgttggtggtgcctgcggtcggcagtgttcaggtgcaggtggtggtcggagatggtgggtccttgacggtgtatgcgcgtgccgcggacgaggagccgtggacgcggcatgcgaccgcggtgctcggggatgccctgcccgcggacgcggacgcggacgcggtgggtgcgggtgcgggtgggtggcagtggccgccggccgacgcctcgtccgtcgacgtctcggacttctacccctccctcgcggacgaggggttcgcctacggtccggccttccagtggctgcggcaggtgtgggtcggaccggaggaagtgttcgccgaggtggccgtggcggacgaagcggccgaccaggcacggaagttcggtgtgcaccccgctctgctggacgcggcgctccaggcgagtaccttcgcgggcctcgaccccgcgccggccggccggatgccgttcagcttcgccgacgtgaccctgcacgcgggcggcgcgacggcgacccgggtgcacatggtgcgtaccggccccgacagcgtcagcgtcgaactggccgacggcaacggtgacccggtgctgacgatcgggacgctggtgctccagccggtcacggcgaccggtccggtcggcggcgcgcaggcgggtgcggtgctggcggtcgactggtcgtcggtggtcgccttggacgaggcggccgggcccggggcgccccttcgggtggtgggcgccccggaggacctcgtcgtggaggatctggttccgggtgaggtcgtggtgttggaggcggtcggtacggcgggtgaggtggtgggttcggctcatgggttggctggttgggtgttggcgcaggtgcaggggtggcttggggatgagcggtgtgcggagggtcggttggtggtggtgacgcggggtgcggtgtcggcggtgccgggggaggtgttggcggatgtggcggcgtcggcggtgtggggtctggtgcgttcggcgcaggcggagaatccggggcggatcaccttgctggaccttggtgccggtgagggggtcgggtcggtcgaccgtgctgtggtggtcggggcggtgaattccggtgagccgcagctcgtggtccgcgacggtgtggtgcgggccgcgcgcctggtccgtgtcgcggctgcggccgacggggacgcggggtcggtgggctttggtgcgggcacggtgctggtcacgggtggtacgggtggtctgggccgtgaggtggcgcgtcacctggtggctgtgcacggggtgcggagtctgctgctgctgagtcgtcggggtctggcggccgagggtgcacgggagttggtcgaggagttgggcgcgctgggcgcggaggtcgtggtcggggcgtgtgacgtcgcggatcgtgcggcgctggcggaggtgctcgcgggtgtgcggctgacgggtgtggtgcacacggctggtgtggtggatgacggtctggtgtcgtcgttgaccgtcgagcggttggatcgggtgttggcgccgaaggtggatgcggcgtggtatttgcacgagttgacggcggggatggatctgtcggcgttcgtggtgttctcgtcgttggccggtgtggtgggtagtccggggcaggggaactacgcggcgggcaatgtgttcttggacgcgttgatgcagtatcggcggctggaggggttgccggcggtgtcgatggcctggggtccgtgggcccaaggtgcgggtctgacgggtgagttgtcggatgtcgacatgcggcggatcgccgcgtcgggaacgccgccgttcacggtggagcagggcctggcggtgttcgacgcggctctgggcagtccggaggcggccgtcgccctgacccggctcgacctcgcggcactgcggacccgcgacgaactgcccccgctctggggcctgctcgccggcaagcgcggtcggccggtggcgagcgaccgccgccaggagtccggcaccctcgccgaccgcctgtcggccctggcccttccggagcgtacggaccagctcctcgttctggtccgcgaccacgtcgcggcggtgctcggcttcgcctcccgcgagcagatcgacaccacccaggcgttccgggagctgggcttcgactcgctcagcgccctcgaactgcgcaaccggttgcagacggcgacgggactcaccgtctcgtcgaccctggtcttcgactaccccaacccgcagcgtctcgccgcgcacctcgccgagcagttcggtacggcggggggagcggagaccggagcggccgcgctgctggcccaactggacgcgctcagcagcacgttggcccgggcggacgtcgtcgacgaggaccgcgaggccatcgcgcaccggcttcgctcgatgctcgacacgtggcgttcccccgaagaggagaacgccgacgaggactgggagacccccgacgaggtcttccgcttcatcgacgacgaactcggtatttccgaaagcgaagtgtga

SEQ ID NO: 2 - protein, 6284 aa, Streptomyces sp. SN-593
MDHEFSDSDVAVIGMACRLPQAPDPAGFWRLLRTGTSAVGEVPADRWPDRPGNDGHDDALRALVRRGAFIDAPDAFDAAFFGVSPRESAEMDPQQRLALELGWEALEDAGVVPETLRGLPVGVYVGAMASDHAHLTSLRSPQALNHHTMAGTHRAVIANRISYFAGLRGPSMTVDTGQSSSLVAVHMACEALRTGEARLALAGGVNLNLTEQTALLEARLGALSPDGRCFTFDERANGYVRGEGGGFVVLKPLRDALADGDDVYCVIRGSAVNNDGAGDSLLVPTVTGQREVLTRAYDRAGIAPGAVQYVELHGTGTKVGDPVEAEALGHALGTDPDREHPLLVGSVKTNVGHLEGAAGITGLLKVALMLKHRRIPASLNFRRLNPDIRADEWNLRVAAEPGPWPEPAGTLHAGVSSFGMGGTNCHVVLSSPVRAEAPPAPETAPGPAADAHPGPAELALVVSAKSPAALRAQAELLLDRMAADPAPDPADVAWSLVGSRSAFPHRAVVVGREAQELTTGLAALAAGEPAAGLVQGHARPDHRVAFVFPGQGAQWTGMATGLMADSPVFRAAIEECAQALRPYVDWSLTDVLDDRAALERVDVVQPALWAVMVSLARLWRWMGVEPAAVVGHSQGEIAAACVAGGLSLDDGARVVALRSQAIAQTLTGRGGMAVVALPAPEAADLIAPWDGRLSIATVNGPGSVVVSGESAAVGELAARCADTGIRVRPVSVDYASHSAAVEEIEDRLLADLAPLRPRAGTVPMYSSVTGAPVDTTELDARYWYRNLRQTVRFETATRALAADGISVLVEVSPHPVLTVPVQDTLDSLGEADGQDGAAGPDGRTGPGGPDAAAGRTAVVTGSLRRDQGGLDRFLTSVAQVHVHGVPVAWAALFEGSRPRRIKLPTYAFQRDRHSVIGLGQEPVRLLEADAGATPGLAPATGDQDDAFLGKLAPMSAKERDAHLLSVVRDHAAALLGHRGGADVDPTVPFRSAGFDSMTAVDLRNRLQSATGLPIPSSMVFDYPTPARLAAFLAGRLGGTRSADDTALPLPAAPVADDPLVIVGMSCRFPGGVAGPEQMWDLVIGERDAITGFPTDRDWDLEHLYGPDTAGRLAGGFVEGALDFDAGFFAMSPREALATDPQQRLLLEGSWEALEHAGIDPVSLAGSATGVFVGSYQSGYAEVVSAALVDADADAQLLTGGAQSVLSGRVAYALGLVGPAVTVDTACSSSLVALHLAGQALRGGECSLALVAGVTVNALPHTFVGFSQQGGLSADGRCKAFAEAADGTGFSEGMGVLVVERLSDAERNGHRVLAVVRSSAVNQDGASNGLTAPNGPSQQRVIRQALAAAGLSSGDVDVVEGHGTGTTLGDPIEAQAVLATYGQDRSEERPLLLGSLKSNIGHTQAAAGVAGVIKMVLAMRHGVVPRTLHVDEPSSHVDWGQGRVRLLTESVAWPESGRPRRAGVSSFGISGTNAHVILEAAPAVESEVEVEVAGGAGAEHASETVWVVSGRSEGALRAQAERLLSVAEGLDPVDVGGALLSRSVFEHRAVVVGSGREELTAGLRALAAGEAAGNAVEGVARSGRRVAVLFAGQGAQRLGMGRRLHEESSVFAAAFDEVVAELDRHLDVPLREVVWGEDAEALNSTGWAQPALFAVEVALFRLLESFGVTPDYLLGHSIGEVAAAYVAGVFDLVDACRLVGARARLMQALPVGGAMVAVAAPEEEVLPHLSDGVSVAAVNAPGSVVVSGEESAVLAVGEHFKALGVKTTRLRVSHAFHSALMEPMVDDFLAAIADVSFSEPRIAVVSNLTGEPADMTSPKYWAQQVRSGVRFADGVAWLTAQGVDVFVDAGPDGVVAGLAQANASDAVAVALMRKDRGDVRTVFHAVGQLFVEGVPVGWETLFAGAGPRRVDLPTYAFQRRRYWPQASLAGGDVIAAGLASAEHPLLSAVVSVPGSGAVVLTSRLSARTQPWLAGHAVQGTVVFPGAGLVELAIRGADAVGAGGLRELEVEAPLVVPETASVQVQVVVADGRLEIYSRATDDDPWTRHATAVLGDALAAGAADWPWPPAADSRVDLPDLSEATDGDGLADGPALQGLRQVWQADGEVFAEVAVAENEADRARKFGVHPDLLEAALRASAFAEPDPVPAGRVWTGFADVTLHAEGATAARARVVRTGPDRVSVELFDGNGEPVLSIGSVTLGAAPASGPLAASRNGTALALDWPALPAAETGADSAEGAGVPDGVDAPGGPAFAFVQAPTADPSWLPEPAYPHLDGVLADGNPPRYVVLAVSGGAPDDMVRAVHATTRWALEQLQSWLAEERFADTTLVALTRGAVSAGHDEPVPDLGAAAVWGLLRTAQREHPGRVVLVDTEPGIDLDVRRLALALRGGEPQLALRGEEIRAARLVRVTAQDAPEARPEPEGTVLVTGGTGGLGREVARHLVAVHGVRSLLLLSRRGLAAEGARELVEELGALGAEVVVGACDVADRAALAEVLAGVRLTGVVHTAGVVDDGLVSSLTAERLDRVLVPKVDAAWHLHELTAGADLAFFAVFSSLSGILGNPGQANYAAGNVFLDALMQARRHAGLPGVSMAWGAWTQDVGLTAALTEADMRRLARSGMRPLSVPEGLALFDRALASDRALLGLASLDLAALRARDDLPVFRSLAGGRARRRAGEQQLAGGLAERMARLTEPEREDFLLTLIRDHAAAVLGHASGQHLNVTTAFREMGFDSLMGVELRNRVKRGTGLPVADSMVYDYPTPLRLAQYLASLMGGVEVRAGGATPARALADDDRLAIVGMACRFPGGVTNPDELWKLIAEGGDAIAGFPDDRGWDVEQLYDAEGTRSGSSVTRSGGFVEADGFDSAFFGISPREALAMDPQQRLLLESSWEALEDAGIDPQSLAGSSTAVVFGISQSHYGELVRPLEETQGHLLTGGAFSVASGRVAYTLGLEGPAVTVDTACSSSLVALHLAGQALRAGECSMALAGGVTVMATPGTFVEFSRQGGLSADGRCRAFADGADGTGWSEGVGVLVVERLSDAERNGHRVLAVVRASAVNQDGASNGLTAPNGPSQQRVIRQALAAAGLNSGDVDAVEAHGTGTRLGDPIEAQALLSTYGQDRPEERPLWLGSLKSNIGHTQAAAGVAGVIKMVLAMRHGVLPQTLHVDEPSSRVDWDQGRVRLLTESVAWPESGRPRRAGVSSFGMSGTNAHVILEAPATPEPPAGAAVPAGIEPGTAADADPQQGAVSPAVGWVLSARSEDGLRGQAGRLLAAVESSGSAGSVEPVDVGAALLSRSLFDHRAVVVGADREQLVSGVRALAAGEPAGNLVGGAAGGGQERRVVFVFPGQGAQWVGMAEGLLNSSSVFRESMELCGEALRPFVEWDLLGVLGEGDEVVLGRVDVVQPVLWAVMVSLAAVWRSWGVVPAAVVGHSQGEIAAACVAGGLSLGDGARVVALRSRAIAGALAGRGGMVAVSLPVEGVRGLLSGGLSVAVVNSPGGVVVAGPVEELDALLVVCEERGVRARRVPVDYASHSVFVELIEDRVLADLAGLAPVSGSVPMYSSVSGERVDTAGLDGGYWYRNLRQTVEFERATRALAADGFSVFVEVSPHPVLTVAVQDTLGEGVVAAGTLRRHEGGLDRFLLSAAELFVHGVPVTWNGLFADRKPRPVSLPTYAFQHQRYWPQPSLVAGDVAAAGLVSAEHPLLGAVVSVPGSDTVVLTSRLSLRAQPWLGDHAVHGTVIFPGTGFVELAIRGADAAGAGRLRELIVEAPLAVPAGGSVQVQVVADAEDHTVAVYARADEDEPWTRHAIGAVDDETAGVDTADLAGEWPPAGSTPVDLEDFYQRSADSGFGYGPVFQGLTRAWRLDGRIYAEAALPDDQAAAATAFGIHPALLDAALHPNTFADLEPTELGRLPFTFDDVTLHATGARAVRIRMARTGPDSVTAVLADETGAPVLSIGSLVMRPVPEQVLGGARAPETMLALVWNEVPDASGAAAGAEPGAAPAQDGDVLLEVPAAADGSPESVHAAVAWTLGQLQGLSGGRLVVLTRGAVAALPGETVTDLAAAAVWGLVRSAQSEDPGRIVLVDADEGTRATRDLLARVAGTGEPQLAVREGALLAPQLTRTTETGEPVALDGTVLITGGTGGLGSAVARHLVAAYGVRSLLLLSRRGGTAPGAAELVEELTAQGAEVTVVACDAADRSALAEVLAGVPLAGVVHTAGILDDGVISTLTPEQVHRVLTPKVDAAWHLHDLTRDRDLAMFVVFSSLAGLIGSPGQGNYAAGNVYLDSLVQQRRAAGLAGISMAWGPWDQSLGLTGALSGTDMHRLGRLGMLPISEEQGMALFDQALSAGLPLLGLTELKASALRATTEVPALFRSLAGGPARRTRARAGAAAPAAGLAGRLAGLTPEQRQSHLLGLVREHAAAVLGHGSGSRIAAEQPFREVGFDSLTAVELRNRLQAVTELSLPSTLVFDYPNAVRLAGYVGERLGGVTAAPVDALPVLRSVDDDPLVIVGMSCRFPGGASDPDRLWDLLEQGRDGMGAFPGDRGWDTGLLTELAHAGGFVEGALDFDAGFFAMSPREALATDPQQRLLLEGSWEALEHAGIDPVSLAGSATGVFVGSYQSGYAEVVSAALVDADADAQLLTGGAQSVLSGRVAYALGLVGPAVTVDTACSSSLVALHLAGQALRGGECSLALVAGVTVNALPHTFVGFSQQGGLSADGRCKAFAEAADGTGFSEGMGVLVVERLSDAERNGHRVLAVVRSSAVNQDGASNGLTAPNGPSQQRVIRQALAAAGLSSGDVDVVEGHGTGTTLGDPIEAQAVLATYGQDRSEERPLLLGSLKSNIGHTQAAAGVAGVIKMVLAMRHGVVPRTLHVDEPSSHVDWGQGRVRLLTESVAWPESGRPRRAGVSSFGISGTNAHVILEAAPGVEAEVEVVEGDGAESGSESGSGSVWVVSGRSEGALRAQAERLLSAVSEAESWGSAAVGAALLSRSVFDHRAVVVGADRAELVAGLGALASGEPGALVAQGVARSGRRVAVLFAGQGAQRLGMGRRLHEESPVFAAAFDEVVAELDRHLEAPLREVLWGEDAEALNSTGWAQPALFAVEVALFRLLESFGVTPDYLLGHSIGEVAAAHVAGVFDLVDACRLVGARARLMQALPVGGAMVAVAAPEEEVLPHLSDGVSVAAVNAPGSVVVSGEEGAVLEVGEHFKALGVKTTRLRVSHAFHSALMEPMVDDFLAAIADVSFSEPRIAVVSNLTGEPADMTSPKYWAQQVRSGVRFADGVAWLTAQGVDVFVDAGPDGVVAGLAQANASDAVAVALMRKDRGDVRTVFHAVGQLFVEGVPVAWETLFAGAGSRRVDLPTYAFQRRRYWPQASLAGGDVAAAGLVSAEHPLLGAVVSVPESGTVVLTSRLSLRAQPWLGDHAVHGTVVFPGAGFVELAIRGADAVGAGGLRELVVEAPLVVPAVGSVQVQVVVGDGGSLTVYARAADEEPWTRHATAVLGDALPADADADAVGAGAGGWQWPPADASSVDVSDFYPSLADEGFAYGPAFQWLRQVWVGPEEVFAEVAVADEAADQARKFGVHPALLDAALQASTFAGLDPAPAGRMPFSFADVTLHAGGATATRVHMVRTGPDSVSVELADGNGDPVLTIGTLVLQPVTATGPVGGAQAGAVLAVDWSSVVALDEAAGPGAPLRVVGAPEDLVVEDLVPGEVVVLEAVGTAGEVVGSAHGLAGWVLAQVQGWLGDERCAEGRLVVVTRGAVSAVPGEVLADVAASAVWGLVRSAQAENPGRITLLDLGAGEGVGSVDRAVVVGAVNSGEPQLVVRDGVVRAARLVRVAAAADGDAGSVGFGAGTVLVTGGTGGLGREVARHLVAVHGVRSLLLLSRRGLAAEGARELVEELGALGAEVVVGACDVADRAALAEVLAGVRLTGVVHTAGVVDDGLVSSLTVERLDRVLAPKVDAAWYLHELTAGMDLSAFVVFSSLAGVVGSPGQGNYAAGNVFLDALMQYRRLEGLPAVSMAWGPWAQGAGLTGELSDVDMRRIAASGTPPFTVEQGLAVFDAALGSPEAAVALTRLDLAALRTRDELPPLWGLLAGKRGRPVASDRRQESGTLADRLSALALPERTDQLLVLVRDHVAAVLGFASREQIDTTQAFRELGFDSLSALELRNRLQTATGLTVSSTLVFDYPNPQRLAAHLAEQFGTAGGAETGAAALLAQLDALSSTLARADVVDEDREAIAHRLRSMLDTWRSPEEENADEDWETPDEVFRFIDDELGISESEV

SEQ ID NO: 3 - DNA, 15633 bp, Streptomyces sp. SN-593
  CDS (1)..(15630)
gtgggagcgatagtgagtgacgacaagtccttcgagtatctgaagaaagtgacttcggagctcaagcgtacccggaaccgactctcggaaatcgagtcgaaatccagggagccgctcgccgtcgtcgggatggcgtgccgcttccccggcggggtcgccggccccgacgacctgtggcacctggtcgcctcgggcaccgacgcggtgtcgctcttccccgccgaccgcggctgggacgtcgagcagctctacgaccccaccggcgaccgcccccacacctcgctcacccgcgagggcggattcctggccgccgccgccgacttcgacgccgggttcttcgggatctccccgcgcgaggcgcaggcgatggacccgcagcagcggctgctgctggaggtgtcgtgggaggcgctggagcacgccggcatcgacccgcgcaccctcgccggcacctccaccggcgtgttcaccggcctgatgtaccacgactacccggcctccgaccaaccggacgccgccgagggcaccggctcggccggcctcggcgccaacggcgccgtcgcctccggccgggtctcctacgtgctgggcctggagggcccggccatcaccgtggacaccgcctgctcctcgtcgctggtcgccatgcactgggccgggcaggcgctgcgctcgggcgagtgctcgctcgccctggccggcggcgtgaccgtgatggcgacccccagcacgtacgtggagttcagccgccagggcggcgccgtgtcacccgacggccgctgccgggcgttctccgaggcggccgacggcaccgggttcagcgagggcgtcggcatcctcgtgctggagcggttgtcggacgcgcggcgcaacgggcacgaggtgctggccgtggtccggtcgagtgcggtgaaccaggacggcgcgtccaacggcctgacggcgccgaacggtccgtcgcagcagcgcgtgatccgccaggcgctggcgtcggccggactgtcgccggccgacgtggacgccgtggaggcgcacggcacgggcacgaccctgggcgacccgatcgaggcgcaggcgctgctgtccacctacggccagggccgccccgacgaccagccgctgtggctcggctcgatcaagtccaacatcggccacacccaggccgccgccggcgtcgccggcgtcatcaagatggtgcaggcgatgcggcacggcgtgctgccccccaccctgcacgccgacctgcccagctcgcacgtcgactggacggccggccaggtccggctgctcaccgagccgcagccctggcccgacgccggccgcccgcgccgggccggcgtgtcctccttcggcgtgtccggcaccaacgcgcacgtcatcatcgaagccgcccccgagaccgaggccgaaccccccgccgcggaccggcccggcgacgaggaccccggactgttcgccccgcacaccgcgatggcgtggaccctgtccgcacgcagcgccaaggcactggccggccaggcgggacgcctgctggagcgtgtgcaggacgccccggaactcgaccccgccgacgtgggctggtcgctgctgcgctcccgcgcgctgttcgagcaccgcgccgtcgtcgtcggcgccgaccgggccgagctgacggccggcctggccgcgctcgccgcgggcgaacccgccgcgaacgtcgtcaccggcgccgcccgctccggcggccgggccgtcttcgtcttccccggccagggctcgcactgggagggcatggccaaggaactcctcgccacctcaccggtcttcgccgcgaaggtccaggagtgcgccgaggcgctcgacccgctcgtcgactggtcgctgctggaagtgctgcgccaccccgaggagtccgcggagctgctgagccgcatcgacgtctaccacccggtcttcttcaccatgatggtggcgctggccgaggtctggcgcgccctgggcgtcgagcccgcggccgtcgtcgggcactcccagggcgaggtcgccgccgcccacgtggccggcgcgctgtccctcagcgacgcctaccgcgtggtcctggtgcgcggcaacatcttcgagaacgtgctgctcggcaagggcgccatcgcctcggtcaagctgggccaggaagcggtcgaggaacagatcgccgggtacgaacggctctccgtcgccggcgtcaactcccgctccggggtgaccgtctccggcagcatggaggacgtcaaggcgtacctcgccgagtgcgaggccgccggcgtccccgcccgcatcctcggcatggccgcctcccactcgcccgccctggaaccgctgcgcgagcggctgctcggcgagctgtccttcgtccgcccccgggccggcaccatccccatgtactccaccgtcgacgccgccctggtcgacaccgccaccctggacgccgagtactggtaccgcaacctgcgctcaccggtgctgttcgagcagaccacgcgcgtcctggtcgacgccggcttcagcgccttcgtcgaggccagctcgcacccggtgctgaccgtgccgctccaggagaccctcgacaccttctaccccgacctcgcggccgacgcggcggtcaccgggacgctgcgccgcaacgagggcggcccggcccggatgctggcgtccgcggcccacctgttcgcgcacggcgtgccggtcgtctgggacggcctgttcgcgggccgcccgccgcgccgggtcgagctgcccacctacgccttccagcaccggcggttctggaacgcgctcccggagcccgcggccggccgcgacccgctggacaccctgttctgggagtccgtcgagggcggacggctggcccagtccctgggtgtggacgacgcggtcgtctccgaggtcgtgccggccctgctgagctggcgcgagcgccggcagcgggaggcggccgccgacgactggacctaccgccagtcctgggtgccggtcgacggactgcggcagggcccgcccgccggccgctggctggccgtcgcggaccgcgccgacgacccctggaccaccggcgtcgccgaggccctcggccccgacacgaccgtcctcgcccgggccgacgcgaccgccgaacggctcgccgcccccggctacgacggcgtcgtctggctgccgcccgccggtgcggacggcccggcggcgaccctcgccctggtccaggcgctgcgcgcgtccgggcagggcgcgccgctgtgggtgctcacccgggccgcggtgtccgcccggcccggcgaacccgtcagcggcatgtggcagggcggcatctggggcctcggccgcgtcgccgccctggaactgccggacctgtggggcgggttggtcgacctgcccgaggagttcgacgccgccgtcgcggcccgcctgggcggcgcgctgtccaccgcccacggcgaggaccagctcgcggtccgcgcctcgggcgtcgtggcccgccgcctcgtgcgcgccgccgtccacggcaccggcgagccctggcacaccggcgggaccgccctggtcaccggcggcaccggcggcctcggggcgcacgtcgcccgctggctggcggagcgcggcgccgagcacctggtgctgctgtcgcgccgcggcccggacgccccgggcgcggccgaactgcgggccgaactggaacaggccggcgcgcgtgtcagcgtgcacgcctgcgacgtggccgaccgcgaggccatgaccgcgatcgtcaccggtctgccggacgacctgccgctgcgcacggtggtgcacgccgccggcgtcggcagcgcactcgtgccggtcgagtccctggacgccggccagttggagttcgagctgcgggtcaaggccgagggcgccctgctgctggacgagttgaccgagggcatggacctggacgcgttcgtgctgttctcgtcgggggcggcgtcctggggcggcagcgggcagggcggttacgcggcgggcaacgcctgcctggacagcctggccgagtaccgccgggcgcgggggcgtaccgccacctccctcgcctggggcggctgggccggccctggcctgaccgacatcgacgccaccttcgtggactacctgcggcgcatgggcgtgctcgccatgcagcccgacctcgccgtcgcggccatgcaacgcgtcctggaacaggacgagaccaccgtcaccgtctccgacatggactggacgaagttcgtccccgcgttcaccctggcccgccccagccgcctgttcgccctgctccccgaagcggccccggccgccgccgagccggccgacgacgacggcggcgacttcgccgcccgggtggccgccatgtccgcggccgagcggcgcgcctacctgaccaccctggtccgcgaccacgccgccgccgtcctcgggcacggcggcggcgacgagatcgaccccggccaggcgttccgcgaggtcggcttcgactcgctgacggcggtggaactgcgcaaccggctccagaccgcgaccggcaccggcctgcccgccaccctggtcttcgactacccgagtgcggcccggctggccggttacctcgccgagcggttcggcgacggcgcggcggcgcaaccggacctgcccgcgctggtgcaggccaccgacgacccgatcgccgtggtcggcatggcctgccgctaccccggcggggtgaccggccccgacgagctgtggaacctggtcgccaccggcacggacgcgatgagcaccttcccggacgaccgcggctgggacctggaggcgctgtacgacccggcgggctaccggccgggcgcgtcggtcacccgcgagggcggcttcgtggactccgcggtggagttcgacgcggggttcttcgggatctccccgcgtgaggcgctggcgatggacccgcagcagcggctgctgctggaggtggcctgggagtcgctggagcacgccggcatcgatccggcggggctcgccgggacggccaccggcgtcttcgtcggcgccgcgtcgtccggctacctggaggccatcgacggcctgcccgagaccgagagccaccggatgaccagcgggctgctgtccgtcatctccggccggctctcctacagcctgggcctggagggcccggcggtgacggtggacaccgcgtgctcgtcgtcgctggtggccatgcactgggccggccaggcgctgcgctcgggcgagtgctcgctcgccatcgccggcggcgtgaacgtgctcgtcagcccggtcgggttcaccgagttcagcaagcagggcggcctcgccgccgacggccgcgtcaaggcgttcgccgaggccgccgacgggaccagttggtccgagggcgccggcgtcgtggtgctggagcggttgtcggacgcgcgccgcaacgggcacgaggtgctggccgtggtccggtcgagtgcggtgaaccaggacggcgcgtcgaacgggttgacggcgccgaacggtccgtcgcagcagcgggtgatccgccaggcgctggcggcggcctccctggcaccgtccgacgtggacgtggtggaggcgcacggcacgggcacgacactgggcgacccgatcgaggcgcaggcgctgctggcgacctacggccagggccgccccgaggaccggccgttgtggctgggcacgatcaagtccaacatcggccactcgcaggccgccgccggtgcggccggcgtcatcaagatggtgcaggccatccgccacggctcgctgccgcccaccctcaacgtggacgagccgagcacgaacgtggactggagcgagggccgggtgcggctgctgaccgaggagcagccgtggccggagaccggccgcccgcgccgcgcgggcgtgtcctccttcggcgtgtccggcaccaacgcgcacgtcatcatcgaggccgcgcccgaggttgaggtcgaggccgccgccgaggacacggacacggacccgggcccgggaacgggcgcggaggcgggccccgggactgccgcgggaacgggcgagcacccggacggcgggaacgccgggcacccgcggggcgccgcactcggcacggacgacaccgtgtgggtcgtctccgggcgctcggcggacgccgtggccggccaggcggaacggctgctggagcgcgtcgagcaggacacgggtccggaccccgtggacgtggcccactcgctgctgacgtcccgttccctcttcgagcaccgtgcggtggtggtgggtgcggatcgctcggaactcgtctccgggttgcgggcgttggcggccggtgaggcggcggggaacgcggtggagggtgtggcgcggagcggccgccgggtggcggtgttgttcaccggtcagggtgcgcagcggctggggatggggcgggagttgtatgaagagtcgccggtgttcgcggcggccttcgacgaggtggtggcggagttggaccggcatcttgaggtgccgttgcgggaggtggtgtggggtgaggacgccgacgcgttgaactccaccggttgggcgcagccggcgttgttcgcggtcgaggtggcgttgttccggctgttggagtcgttcggggtgaggccggattacctgttggggcactccattggtgaggtggctgcggcttacgttgccggggttttcgatctggtggatgcgtgccggttggtgggggcgcgggcgcgtttgatgcaggcgcttccctcgggtggggcgatggtggccatcgccgcttccgaggacgacgtgctgccgcatctgtccgacggggtgtcggtggcggcggtgaacgcgccgggttcggtggtggtctccggtgaggagtccgctgtgctcgcggtcggtgagcatttcaaggcggtgggggtgaagacgacccggctgcgcgtctcgcacgccttccactcggtcctgatggagccgatgctggacgacttcctggccgcgatcgcggatgtgtcgttctccgagcctcggatcccggtggtgtcgaacctgacgggtgagccggcggacatgacgtcgccgaagtactgggcacagcaggtgcgttcggcggtccgcttcgcggacggactggcatggctgacggcgcagggcgtggacgccttcgtcgaggcgggaccggacgcggtgctggccggactggtggagtccgacggcgccaccgcggtggccgtgcagcgccgcgaccgcaccggggcccggaccgtcctccaggcgctggcacggttgttcgcggagggcgtgccggtcgactgggacggcctgttcgcgggccgcccgccgcgccgggtcgagctgcccacgtacgccttccagcggcgccgttactggccggagggcggcacggccgccgccgacgtggcggccgccggcctgatggcggtcgaacacccgctgctgggcgcggtggtgccgtcgcccgagggcggcggggtggtgttcacctcgcggctgtcggtcgcgtcgcagccgtggctggccgaccacgccgtgcagggtgtggtgctcttcccgggcaccggtttcgtggaactcgcggtgcacgccgcggacgcggtcggctgcggccgggtccgcgaggtgatcgtggaggcgccgctggtgctgccggagcgcggcggcgtgcaggtccaggtggtcgtcggcgaacccgaggacggccggcgcccgttcacggtgtacgcgcgccccgacacgggcggcgagcagccctgggtccggcaggccagcggtgccgtggacgacgcggccggggccgacgcggccgggttcgaggcgctggccggcgtgtggcccccggcgggcgcggacgtgctggagaccgacgggatctacgagcggatcgccgagcagggcttcgtgtacggcccctcgttccgcggcctggcccgcgcctggcgccgcgacgggcaggtcttcgccgaagtggcgctgcccgaggcgcagtcgggccgggcgggcgctttcggcctgcacccggcgctgctggacgcggtgatgcacgcgctggccttcgtggacctggagccggcggagttcggccggctgccgttcagcttcggcgacgtggcgctgcacgcctccggcgcggggcgggtgcgcgcctgcctgacgcggaccggacccgactcggtggcgatcgccgtggccgacgaggccggtgacgcggtgctgtcgctgggctcgctggtggtacgcccgctgaccccgcaggcgctgagcgccgcgggcggcggccgggacgaggccgtcctggccccgcggtggactgcgctggacacgcaggacccggcgctggacgactgggagagcgtggccgccgcagtcgtggcggggcccggccagcgcgtggactggctgccgggcgcggtgctgcacccgcacgccggggacgtggtgtcggacgcggcactgccgctggtgatcgccgtgaccggtggcgaccgcccggtcgagggggcccacgaggccacccggtggatgctggaccagctccagacctggcagtccggggcccgggagctcgtcgtggtgacctcgggcgcggtggccgccggccccgacgagtcggtcaccgacctgggcgccgccgcggtatggggcctggtgcgttcggcgcaggcggagaaccccggccggatcaccctggtcgacaccgacgccgccaccggcatgacggccggcctgctggccgccgcgcgcgccaccggggagccgcaactcgcggtacgggcgggccggttgcacgcggcgcggttggcgcgtgcggatgtcgggctggtggcgccggagtcgggtgcctggcacctggactccatggcgaaggggacgttggagaacctgcggttggtgccgttcccggaggcggagcgggcgttgtccgacggtgaggtgcggatcgaggtgcgggcggcggggttgaacttccgcgacgtcctcaacgccctgggcatgtacccgggcgaggcgggcccgttgggcggcgaggtggccggcgtggtgaccgaggtcggcgcgggcgtgtccgacctgcgggtcggcgaccgcgtcatgggcctgagcgacggcggtctcggctccgtcaccgtgaccgaccggcggctggtcgcgccgatcccgtcgggctggtcgtacacgacggccgcgtcggtgccgacggtcttcctgaccgcgtactacggactggtggacctggccggggtgcggtcgggcgagcgggtgctggtgcacgcgggcgccggcggcgtcggcatggccgcgctgcaactcgtcgcgcacctgggcgccgaggcgtacacgaccgcgagcgagggcaagtggccggcgctgcgggagcggggggtggaggcggcgcgtctggcgtcgtcgcggacgctggacttcgaggaggcgttcctgcgggagaccggggggcgcggggtggacgtggtgctgaactccctgacgggggagttcatcgacgcgtcgctgcggttgatgccgggtggcggccgcttcgtcgagatgggcaaggccgacctccgcaccgacgagcagatcggcgccgtgcacccgggcatcagctaccacacctacgacctggtgcaggccgggcccgaccgggtccagcagatgttgctggagttggtggggttgttcgagtcgggtgtgttggtgccgttgccggtggtggagtgggatgtgcggcgggcgccggaggcgttccggttcatgagtcaggcgcggcatgtgggcaagatcgtgttgacggtgggtcggcgggtggtgggtgagggggcggttctggtcactggggggactggtggtctggggggtgtggtggcgaggcatctggtggtggagcacggggtgcgggatctggtgttggtgtcgcgtcgggggttgggggcgccgggtgcggaggagttggtggcggagctttcgggtcggggtgctcgggtggaggtggtggcgtgtgatgtgagtgatcgtgaggcgttggcgggggtggtggcggggatgtgtgcgtcgggtgtgttggcgggtgtggtgcatacggcgggtgtggtggatgacgggttggtgtcgtcgttgtcgggggagcggttgggtccggtgttggcgccgaaggtggatgcggggtggtggctgcatgagttgacgcgggggttggatctgtcgttgttcgcggtgttctcgtcgatgtcgggtctggtgggggctccggggcagggcaactacgcggcggcgaacgtgttcctggacgcgttggtggagcggcgtcggagtgaggggctgccgggcgtgtcgatggtctggggtccgtggacccccgaggtcggcctcaccggcgccctgtccgaggccgatctccgccggctgcacagctccggtacgccgccgttgtcggtggagcagggcatgcggctgttcgaccaggccgtgctcgcggacgcgcccgtcctcgcgctcacccgcctcgacgccgccgtgctgcgcggccaggccgacctgcccgtgatgctccgggaactggtcggggccaggccgcggcgggccgcggccggcgcacggcagcagtccgggggcctcgcggggcagttggccgggctcagtgcccagcagcgcgaccagcacctgctggccctggtccgcgacaacgtcgcggtcgtcctcggccacggcggcggtcaggacgtcgatcccggccaggcgttccgggaggcgggcttcgactcgctgacggccgtggaactgcgcaaccgcctccagagcgcgaccggcctcgcactgccggccacgctcgtcttcgactaccccaacgcgacccggctcgccgccttcctcgccgagcagttcggcgacgccgccgagcccgccgcccggccggacctgcccgcgctggtctcggtgaccgacgacccgatcgtcgtcgtgggcatggcctgccgcttccccggcggtgtgaccggccccgacgacctgtgggacctggtcgcctccggcacggacgcgatgtcccccttcccggcggaccgcggctgggacctggacggcctccacgacccgacgggcacccgcccgaacacgtccgtggccgacgagggcgggttcctggcctccgccgccgacttcgacgccgggttcttcgggatctccccgcgcgaggcgctggcgatggacccgcagcagcgcatggtcctcgaagtggcctgggaggcgctggagcacgcgggcatcgacccgaccggactcggcggcaccccggccggcgtcttcgtcggcagctaccactccggctacagcgacctcgtcgtggagtccggcggcgacgcgcaggcccaactgctcaccggcgccgcgcagagcgtgctgtccgggcgggtctcctacgtcctcgggctggagggcccggcggtgacggtggacaccgcgtgctcgtcgtcgctcgtcgcgatgcacctggcgagccagtcgctgcgctcgggcgagagcacgctcgcgctggcgggcggcgtgaccgtgatggccacccccgggacgttcgtggagttcagccggcagggcgggctcgcggccgacgggcgctgcaaggcgttcgccgagtccgccgacggcaccggctggtccgagggcgcgggcatcgtggtgctggagcggttgtcggacgcggagcggaacgggcatcgggtgctggcggtcatgcgctccagcgcggtgaaccaggacggtgcgtcgaacgggttgacggcgccgaacggtccgtcgcagcagcgggtgatccgccaggcgctggccgccgcggggctctcaccggccgacgtggacgccgtggaggcgcacggcaccggcacctcgctgggcgacccgatcgaggcacaggcggtgctggccgcctacggacaggaccgccccgaggaccggccgctctggctcggctcggtcaagtccaacctgggccacacgcaggcggcggccggtgtcgtgggcgccatcaagatggtgcaggcgctgcgtcacggggtgctgccccggaccctgcacgtggacgagccgagcacgcacgtggactggggccagggccgggtgcggttgctgacggagtcggtgccgtggccggagaacgggcacccgcggcgggcgggtgtctcctcgttcgggatctcggggacgaacgcgcacgtgatcttggaggcggctcccgcggtggagtccgaggtcgaggcgcgggtcgaggtcgcgggagaggctggggccgagtccgagtccgggtcggggtcggtgtgggtggtgtcgggtcgttcggagggggcgttgcgggcgcaggcggagcggttgttgtctgtggccgaggggctggatccggtggatgtgggtggggcgttgttgtcgcggtcggtgttcgagcaccgtgcggtggtggtgggcagtgggcgtgaggaactgacggcggggttgcgggcgttggcggccggtgaggtggcgggcaacgcggtggagggtgtggcgcggagcggccgccgggtggcggtgttgttcgcgggtcagggtgcgcagcggctgggaatgggccgccggctgcacgaggagtcgccggtgttcgcggcggccttcgacgaggtggtggcggagttggaccggcacctcgaggcgccgttgcgggaggtgctgtggggcgaggacgccgaggcgttgaactccaccggttgggcgcagccggcgttgttcgccgtggaagtggcgctgttccggctgctcgaatccttcggcgtcacaccggattacctgctggggcactccatcggtgaggtggccgcggcttacgtcgccggggtgttcgatctggtggatgcgtgccggttggtggccgcgcgggcccgtttgatgcagcagcttccctcgggtggggcgatggtggccatcgccgcttccgaggacgacgtgctgccgctcttgtcggacggggtctctgtcgcggcggtgaacgcgccgggttcggtggtggtctccggtgaggagggcgctgtgctcgcggtcggtgagcatttcaaggcgttgggggtgaagacgacccggctgcgggtgtcgcacgccttccattcggcgttgatggagccgatggtggacgacttcctggcggcgatcgcggaggtgtcgttctccgagccgcggatcccggtggtgtcgaatctgacgggtgagccggcggacatgacgtcgccgaagtactgggcgcagcaggtgcgttcggcggtccgcttcgcggacggactggcgtggctgaccgcgcagggtgtggacgtgttcgtggatgcgggtcctgatggtgtggtggcgggtctggcgcaggcgaacgcgtcggatgcggtggcggtggcgttgatgcgcaaggaccgtgggggtctggacacggcgttgctggccgctggtgacctgttcgtgcacggggtgccggtggagtgggcgggtctggtcggtgggcggggggcggagtgggtcgagctgccgacgtacgccttccagcgccgccgctactggcccgacgcggctgttccgacgacgggtcaggagccgggccgcgacccgctggacgcgctgttctgggaatccgtcgagcacgggcggctggccgagtcgctgggtgtcgacgacgccgcggtctcgggcgtcgtgcccgccctgctggactggcgcgagcggcgccgccgcgagatggcggccgacgactggcgctacgaccagcgctgggtcccggtcgacggtgtcccgcgcggcgccacggcggaccgccggctggtggtcgtgcccgccggggcggacgcctggacccgcggagtcgtggacgcgctgggcgacggcgtgaccgtcctggaggccgaggcggcggacgcggaccggctggccgccgagggcgcggagtgcaccgccgtggtgtggctgccgcccgccgaggagtccggggtcgcggcgacgctgcgcctggtccaggaactgcgcggggccggggtgccggctcccctgtgggtggtcacccgcggcgcggtcgccgcccggccggacgaccgggtcgacggcgtctggcacggcggtgtctggggcctcggccgtgtcgcggccctcgaactgcccgacctgtggggcgggttggtggacctgcccgaggaggtggacgggacggtggcagcccggctgtcgggcgtgctgtccggcggccacggcgaggaccagctcgccgtccgtgcctcgggcgtcctcgcccgccgactggtccacgcgaccggccgggacggcgccgcggagccgtggcgtaccggcgggacggcgatcgtcaccggcgggaccggcggtctgggcggccgcgtggcccgctggctggtggaccgcggcgccgagcacctggtgctgctctcgcgccggggcgccgacgcccccgggaccgcggacctcacggcggggctcgaagccgcgggcgcccgggtcacggtggtcgccggcgacgtggccgaccgggcggtgctggccgaggcgttcgccgcggtgccggcggacctgccgctgcggacggtggtgcacgccgcgggcgtgggcaacgcgttcacgccgttggagtccatgacgcccgagcggctcgcggacgagctgcgggtcaaggccggcggcgcgctgctgctggacgagttgaccgagggcatggacctggacgcgttcgtgctgttctcgtcgggtgcggcgtcctggggcggcagcgggcagggcggttacgcggcgggcaacgcctgcctggacagcctggccgagtaccggcgggcccggggccgtaccgccacgtcggtggcctggggcacctgggccgaggtcgggatggccgcgggcagttccgacggccacgaccacctggcgcgcctgggcgtctccgccatggcgcccgacctcgcgatcatcgctctgcaacgggtgatcgaggacgacgcggccacggccaccgtctccgccatggactggtccaccttcgccccggcgttcaccctggcgcgccccagcaacctcttcgccctgcttcccgaggccgtcccggcggccccggacgcggccgaggcggacaccgggttcgctcagcacctcgcggcgctgccggacgaggagcggcgcgaggaactgctcgccctggtccgggagcacaccgcggccgtgctcggccacgacagcgccagggacgtcgatcccgcccaggcgttccgcgacgccgggttcgactcgctcaccgcggtcgagctgcgcaaccggttgcagcggcgtaccgggctcgcgctccccgcgacgctcgtcttcgaccacccgaacccgaaccggctcgtcgaccacctggccggggaactggtcggcggcggggacgcggcgggcggactggacgagctgagggaccggttgcagacgttcgccgccgacccggcggtccgcgaggacctggaggcgatgctgcgccaggtgctcggcgccgtcgaggacgcgaccgccgcgcagcgcggcgacatcgacgccgcctccgacgaggagctgttctccatggtcgaccaggggagcagttggatgtccgattcttcgtcgaccgccgaccacgagtga

SEQ ID NO: 4 - protein, 5210 aa, Streptomyces sp. SN-593
MGAIVSDDKSFEYLKKVTSELKRTRNRLSEIESKSREPLAVVGMACRFPGGVAGPDDLWHLVASGTDAVSLFPADRGWDVEQLYDPTGDRPHTSLTREGGFLAAAADFDAGFFGISPREAQAMDPQQRLLLEVSWEALEHAGIDPRTLAGTSTGVFTGLMYHDYPASDQPDAAEGTGSAGLGANGAVASGRVSYVLGLEGPAITVDTACSSSLVAMHWAGQALRSGECSLALAGGVTVMATPSTYVEFSRQGGAVSPDGRCRAFSEAADGTGFSEGVGILVLERLSDARRNGHEVLAVVRSSAVNQDGASNGLTAPNGPSQQRVIRQALASAGLSPADVDAVEAHGTGTTLGDPIEAQALLSTYGQGRPDDQPLWLGSIKSNIGHTQAAAGVAGVIKMVQAMRHGVLPPTLHADLPSSHVDWTAGQVRLLTEPQPWPDAGRPRRAGVSSFGVSGTNAHVIIEAAPETEAEPPAADRPGDEDPGLFAPHTAMAWTLSARSAKALAGQAGRLLERVQDAPELDPADVGWSLLRSRALFEHRAVVVGADRAELTAGLAALAAGEPAANVVTGAARSGGRAVFVFPGQGSHWEGMAKELLATSPVFAAKVQECAEALDPLVDWSLLEVLRHPEESAELLSRIDVYHPVFFTMMVALAEVWRALGVEPAAVVGHSQGEVAAAHVAGALSLSDAYRVVLVRGNIFENVLLGKGAIASVKLGQEAVEEQIAGYERLSVAGVNSRSGVTVSGSMEDVKAYLAECEAAGVPARILGMAASHSPALEPLRERLLGELSFVRPRAGTIPMYSTVDAALVDTATLDAEYWYRNLRSPVLFEQTTRVLVDAGFSAFVEASSHPVLTVPLQETLDTFYPDLAADAAVTGTLRRNEGGPARMLASAAHLFAHGVPVVWDGLFAGRPPRRVELPTYAFQHRRFWNALPEPAAGRDPLDTLFWESVEGGRLAQSLGVDDAVVSEVVPALLSWRERRQREAAADDWTYRQSWVPVDGLRQGPPAGRWLAVADRADDPWTTGVAEALGPDTTVLARADATAERLAAPGYDGVVWLPPAGADGPAATLALVQALRASGQGAPLWVLTRAAVSARPGEPVSGMWQGGIWGLGRVAALELPDLWGGLVDLPEEFDAAVAARLGGALSTAHGEDQLAVRASGVVARRLVRAAVHGTGEPWHTGGTALVTGGTGGLGAHVARWLAERGAEHLVLLSRRGPDAPGAAELRAELEQAGARVSVHACDVADREAMTAIVTGLPDDLPLRTVVHAAGVGSALVPVESLDAGQLEFELRVKAEGALLLDELTEGMDLDAFVLFSSGAASWGGSGQGGYAAGNACLDSLAEYRRARGRTATSLAWGGWAGPGLTDIDATFVDYLRRMGVLAMQPDLAVAAMQRVLEQDETTVTVSDMDWTKFVPAFTLARPSRLFALLPEAAPAAAEPADDDGGDFAARVAAMSAAERRAYLTTLVRDHAAAVLGHGGGDEIDPGQAFREVGFDSLTAVELRNRLQTATGTGLPATLVFDYPSAARLAGYLAERFGDGAAAQPDLPALVQATDDPIAVVGMACRYPGGVTGPDELWNLVATGTDAMSTFPDDRGWDLEALYDPAGYRPGASVTREGGFVDSAVEFDAGFFGISPREALAMDPQQRLLLEVAWESLEHAGIDPAGLAGTATGVFVGAASSGYLEAIDGLPETESHRMTSGLLSVISGRLSYSLGLEGPAVTVDTACSSSLVAMHWAGQALRSGECSLAIAGGVNVLVSPVGFTEFSKQGGLAADGRVKAFAEAADGTSWSEGAGVVVLERLSDARRNGHEVLAVVRSSAVNQDGASNGLTAPNGPSQQRVIRQALAAASLAPSDVDVVEAHGTGTTLGDPIEAQALLATYGQGRPEDRPLWLGTIKSNIGHSQAAAGAAGVIKMVQAIRHGSLPPTLNVDEPSTNVDWSEGRVRLLTEEQPWPETGRPRRAGVSSFGVSGTNAHVIIEAAPEVEVEAAAEDTDTDPGPGTGAEAGPGTAAGTGEHPDGGNAGHPRGAALGTDDTVWVVSGRSADAVAGQAERLLERVEQDTGPDPVDVAHSLLTSRSLFEHRAVVVGADRSELVSGLRALAAGEAAGNAVEGVARSGRRVAVLFTGQGAQRLGMGRELYEESPVFAAAFDEVVAELDRHLEVPLREVVWGEDADALNSTGWAQPALFAVEVALFRLLESFGVRPDYLLGHSIGEVAAAYVAGVFDLVDACRLVGARARLMQALPSGGAMVAIAASEDDVLPHLSDGVSVAAVNAPGSVVVSGEESAVLAVGEHFKAVGVKTTRLRVSHAFHSVLMEPMLDDFLAAIADVSFSEPRIPVVSNLTGEPADMTSPKYWAQQVRSAVRFADGLAWLTAQGVDAFVEAGPDAVLAGLVESDGATAVAVQRRDRTGARTVLQALARLFAEGVPVDWDGLFAGRPPRRVELPTYAFQRRRYWPEGGTAAADVAAAGLMAVEHPLLGAVVPSPEGGGVVFTSRLSVASQPWLADHAVQGVVLFPGTGFVELAVHAADAVGCGRVREVIVEAPLVLPERGGVQVQVVVGEPEDGRRPFTVYARPDTGGEQPWVRQASGAVDDAAGADAAGFEALAGVWPPAGADVLETDGIYERIAEQGFVYGPSFRGLARAWRRDGQVFAEVALPEAQSGRAGAFGLHPALLDAVMHALAFVDLEPAEFGRLPFSFGDVALHASGAGRVRACLTRTGPDSVAIAVADEAGDAVLSLGSLVVRPLTPQALSAAGGGRDEAVLAPRWTALDTQDPALDDWESVAAAVVAGPGQRVDWLPGAVLHPHAGDVVSDAALPLVIAVTGGDRPVEGAHEATRWMLDQLQTWQSGARELVVVTSGAVAAGPDESVTDLGAAAVWGLVRSAQAENPGRITLVDTDAATGMTAGLLAAARATGEPQLAVRAGRLHAARLARADVGLVAPESGAWHLDSMAKGTLENLRLVPFPEAERALSDGEVRIEVRAAGLNFRDVLNALGMYPGEAGPLGGEVAGVVTEVGAGVSDLRVGDRVMGLSDGGLGSVTVTDRRLVAPIPSGWSYTTAASVPTVFLTAYYGLVDLAGVRSGERVLVHAGAGGVGMAALQLVAHLGAEAYTTASEGKWPALRERGVEAARLASSRTLDFEEAFLRETGGRGVDVVLNSLTGEFIDASLRLMPGGGRFVEMGKADLRTDEQIGAVHPGISYHTYDLVQAGPDRVQQMLLELVGLFESGVLVPLPVVEWDVRRAPEAFRFMSQARHVGKIVLTVGRRVVGEGAVLVTGGTGGLGGVVARHLVVEHGVRDLVLVSRRGLGAPGAEELVAELSGRGARVEVVACDVSDREALAGVVAGMCASGVLAGVVHTAGVVDDGLVSSLSGERLGPVLAPKVDAGWWLHELTRGLDLSLFAVFSSMSGLVGAPGQGNYAAANVFLDALVERRRSEGLPGVSMVWGPWTPEVGLTGALSEADLRRLHSSGTPPLSVEQGMRLFDQAVLADAPVLALTRLDAAVLRGQADLPVMLRELVGARPRRAAAGARQQSGGLAGQLAGLSAQQRDQHLLALVRDNVAVVLGHGGGQDVDPGQAFREAGFDSLTAVELRNRLQSATGLALPATLVFDYPNATRLAAFLAEQFGDAAEPAARPDLPALVSVTDDPIVVVGMACRFPGGVTGPDDLWDLVASGTDAMSPFPADRGWDLDGLHDPTGTRPNTSVADEGGFLASAADFDAGFFGISPREALAMDPQQRMVLEVAWEALEHAGIDPTGLGGTPAGVFVGSYHSGYSDLVVESGGDAQAQLLTGAAQSVLSGRVSYVLGLEGPAVTVDTACSSSLVAMHLASQSLRSGESTLALAGGVTVMATPGTFVEFSRQGGLAADGRCKAFAESADGTGWSEGAGIVVLERLSDAERNGHRVLAVMRSSAVNQDGASNGLTAPNGPSQQRVIRQALAAAGLSPADVDAVEAHGTGTSLGDPIEAQAVLAAYGQDRPEDRPLWLGSVKSNLGHTQAAAGVVGAIKMVQALRHGVLPRTLHVDEPSTHVDWGQGRVRLLTESVPWPENGHPRRAGVSSFGISGTNAHVILEAAPAVESEVEARVEVAGEAGAESESGSGSVWVVSGRSEGALRAQAERLLSVAEGLDPVDVGGALLSRSVFEHRAVVVGSGREELTAGLRALAAGEVAGNAVEGVARSGRRVAVLFAGQGAQRLGMGRRLHEESPVFAAAFDEVVAELDRHLEAPLREVLWGEDAEALNSTGWAQPALFAVEVALFRLLESFGVTPDYLLGHSIGEVAAAYVAGVFDLVDACRLVAARARLMQQLPSGGAMVAIAASEDDVLPLLSDGVSVAAVNAPGSVVVSGEEGAVLAVGEHFKALGVKTTRLRVSHAFHSALMEPMVDDFLAAIAEVSFSEPRIPVVSNLTGEPADMTSPKYWAQQVRSAVRFADGLAWLTAQGVDVFVDAGPDGVVAGLAQANASDAVAVALMRKDRGGLDTALLAAGDLFVHGVPVEWAGLVGGRGAEWVELPTYAFQRRRYWPDAAVPTTGQEPGRDPLDALFWESVEHGRLAESLGVDDAAVSGVVPALLDWRERRRREMAADDWRYDQRWVPVDGVPRGATADRRLVVVPAGADAWTRGVVDALGDGVTVLEAEAADADRLAAEGAECTAVVWLPPAEESGVAATLRLVQELRGAGVPAPLWVVTRGAVAARPDDRVDGVWHGGVWGLGRVAALELPDLWGGLVDLPEEVDGTVAARLSGVLSGGHGEDQLAVRASGVLARRLVHATGRDGAAEPWRTGGTAIVTGGTGGLGGRVARWLVDRGAEHLVLLSRRGADAPGTADLTAGLEAAGARVTVVAGDVADRAVLAEAFAAVPADLPLRTVVHAAGVGNAFTPLESMTPERLADELRVKAGGALLLDELTEGMDLDAFVLFSSGAASWGGSGQGGYAAGNACLDSLAEYRRARGRTATSVAWGTWAEVGMAAGSSDGHDHLARLGVSAMAPDLAIIALQRVIEDDAATATVSAMDWSTFAPAFTLARPSNLFALLPEAVPAAPDAAEADTGFAQHLAALPDEERREELLALVREHTAAVLGHDSARDVDPAQAFRDAGFDSLTAVELRNRLQRRTGLALPATLVFDHPNPNRLVDHLAGELVGGGDAAGGLDELRDRLQTFAADPAVREDLEAMLRQVLGAVEDATAAQRGDIDAASDEELFSMVDQGSSWMSDSSSTADHE

SEQ ID NO: 5 - DNA, 11175 bp, Streptomyces sp. SN-593
  CDS (1)..(11172)
atggccactgaagaacagctgcgttcctatctgaagacggccgtggcgaactcgcgcgaggcgcagcggcagctgaacgagatcaagggcaggcgggacgagccgctcgccatcgtgggcatggcctgccgctaccccggcggcgtgaccggccccgacggcctctgggacctggtcgcctcgggcaccgacgcggtgtcggtgttccccgccgaccgcggctgggacgccgacgcgctctacgacccggagggcgcccccggcacgacgtccacccgcgagggcggcttcgtggacgcggtggcggacttcgacgcggggttcttcgggatctccccgcgtgaggcgttggcgatggacccgcagcagcggctgctgctggaggtggcctgggagtcgctggagcacgccggcatcgatccggcggggctcgccgggacggccaccggcgtcttcgtcggggcgtcctcctcggggtacatggaggcgatcgggggcatgcccgagaccgagagccaccggatgaccagcgggctgctgtccgtcatctccggccggctgtcctacgtcctcgggctggagggcccggcggtgaccgtggacaccgcgtgctcgtcgtcgctggtggccatgcactgggccggccaggcgctgcgctcggacgagtgctcgctcgccatcgccggcggcgtgaacgtggcggtgagcccggcggggttcgtggagttcacccggcagggcggcctcgcgcccgacggccgctgcaaggcgttcgccgaggcggccgacggcacgggctggtccgagggcgccggcgtcgtggtgctggagcggttgtcggacgcgcggcgcaacgggcaccgggtgctggccgtggtgcggtccagcgcggtgaaccaggacggcgcgtcgaacgggctgacggcgccgaacggtccgtcgcagcgccgggtgatccgccaggccctggcgtccgtcgggctcgcgcccaccgaggtcgacgcggtcgaggcgcacggcaccggcaccgtgctgggcgacccgatcgaggcgcaggcgctgctggcgacctacggccagggccgccccgaggaccggccgttgtggctgggcacgatcaagtccaacatcggccactcgcaggccgccgccggtgtcgcgagtgtgatcaagatggtgcaggcgatacgccacggcgtgctcccgcgcaccctgcacgtggacgagccgagcaagcgggtggactggagccgcggccgggtgcggctgctgaccgaggagcagccgtggccggagaccggccgcccgcgccgcgcgggcgtgtcctccttcggcgtgtccggcaccaacgcgcacctcatcctcgaagccgcgcccgcgcttgcacccgcgctcgaacccgcgcctgctcccgctcccgggtccgcggagaccgccgcttccgcgtccgggaacacggccgccgcggccgcccccggcgcggccgcccggaccgccgacgacaccccggagagcggggccgccgtctccggagccctgccgtgggtgctctccgcccggtccccgcaggcgctcgccgcgcaggccggacggctgctggagcacgtcgagcaggacccgcggccggaccccgccgacgtggcgtactcgctgctgcgctcccgttccctgttcgaccaccgcgccgtggtcgtcggcgccgaccgggaggaactgaccgccgggctgcgcgcgctggccgccggggagccggccgccgccgtcgccgagggcgtcgccgaggccggccggcacaaaccggtgttcgtcttccccggtcagggctcccagtgggtcggcatggccggcgaactgcgtgcggcctcaccggtgttcgcccaggcactcgacgcgtgcgcggacgcgctcgccgagttcgtggactggtcgctgctggacgccctggacgacgaggacctgctcgcccgcgtcgacgtcgtgcaacccgccctgtgggcggtcatggtgtcgctggcccgggtgtgggagtcgctcggcgtgcgccccgccgcagtggtgggccactcccagggcgagatcgccgcggcctgcgtggccggcgcgctgtcgctgtccgacggcgcccgggtcgtcgccctgcgcagccgcgccatcgccgaggaactggccggcgacggcggcatggtcgccgtcccgctgccggtggcacaggcggaggaactcctcgcccgctggggcgaccgcgtctccgtcgccgcgatcaacggccccgggtccgtggtcgtctccggcgtcccggacgccctcgacgaactcctcgcccactgcgaggacaccggggtgcgggcgaagcgggtcccggtggactacgcctcgcactccgccgcggtcgagcggatcgaacggcggctcgcggcggacctcgccgccgtcgccccccggtccggcgcggtgccgatgtactcgaccgtcaccgcggagccgatcgacaccgccgggctcgacgccgcctactggtaccgcaacctgcgccggaccgtccgcttcgaggacgccaaccgcgcgctggccgaggccggctacacggtgttcgtcgagatcagcccgcacccggtgctcacgatgccggtgcaggacacgctcggcgacgaggccgtggtcaccggcacgctgcgccgccacgagggcggtccggcccgcttgctgctgtccgcggcccacctgtacgcccacggcgtgccggtcgcgtgggacggactgttcgccggtgccgcgccggccgtggtggacctgccgacgtacgccttccagcggcgccgctactggcccgagggcggcaccgccgcggccgacgtgacggccgccggcctggaggaggtgcggcacccgttgctcggcgcggtgctctcctcgcccgagggcggcggggcggtgttcacctcgcggctgtcggtcgcgtcgcagccctggctggccgaccacgccgtgcggggtgtggtgctcttccctggcaccggcttcgtcgaactggtcgtccacgccgcggacgtggtcggctgcggccgggtccgcgagctgatcgtggaggcgcccctggtgctgcccgagagcggcgggatgcaggtccaggtcgtcatgggcgcgcccgaggacggccggcgcacgttcacggtgtacgcgcgccccgacggcggcggggaccggtcctgggtccggcacgccgccggcgtggtggagggcgcggaggcaccggaggccgccgggttcgagccgctggccggcgcgtggccgcccccgggcgccgaggcgctggagaccggcgacgtgtacgagcggaccgccggcggcggcttcgcctacggccccaccttccagggcctgacccgcgcatggcgccaggacggccgggtcttcgccgaagtggcgctgcccgagcagcagtggggccgggccggggcgttcggcctgcacccggcgctgctggactcggtgctgcacgcctcgctgttcgcggggctggcacccgccgagttcggccggctgccgttcagcttcgaggacgtggtgctgcacgcctccggcgccaccgaggtgcgcgcctgcctgacgccgaccgggcccgactcgctgtcggtcctggtgaccgacccggcgggcggcccggtgctgtcggtgggctcgctggtgatgcgcccgctgaccccgcagacgctgacggccgccgggcgccgcgacgaggccgtcctgtccgtggagtggaccgaactgcccgccggggccgaggagtccgcgggcccgggcgcgggctccggcgcgggcctcgacgcggtgctcggcccggtggcggcgggcccggacgcggaggtgccgtggctgccgggggtgccggtccaccgggacctggcggacgtgcggccggaggcgggccgccccgtggtgctggccgtggcggcgcaggacggtccggtcgtggcggccgcccacgcggctgcccgctgggtcctggagcaggtgcagacctggctgcgggacgcggcgttcgccggttcctcgctgctggtgctgacccgcggcgcggtcgccgccggggccaccggggccggcggggaggtggccgacctggccgccgccacggcctggggcctggtgcgttcggcgcaggcggagaaccccggccggatcaccctggtcgacaccgacccgtccgccgccgtggctgcgggccccctcgccgcggcactggccggcggcgagccgcaactcgcgctgcgggcgggccggttgcgcgcaccgcggttggcgcgtgcggatgtcgggctggtggcgccggagtcgggtgcctggcacctggactccatggcgaaggggacgttggagaacctgcggttggtgccgttcccggaggcggagcgggcgttgtccgacggtgaggtgcggatcgaggtgcgggcggcggggttgaacttccgcgacgtcctcaacgccctgggcatgtaccccgacccggacgagccgatgggcagcgacgtggccggcgtggtcaccgaggtcggcgcgggcgtgaccgacctgcgggccggcgaccgcgtcatgggcatcaccaacggcggcctcggctcggccgtggtggtcgaccggcggctggtcgcgccggtccccgcgggctggtccttcgccaccgccgcctccgtgccgacggcgttcctgaccgcgtactacgcgctggtggacctggccgaactgcggtcgggcgagcgggtgctggtgcacgcgggcgccggcggcgtcggcatggccgcgctccagatcgccggacacctcggcgccgaggtctacagcaccgccagcgacggcaagcgcgacctgctgcgggagcggggggtggaggcggcgcgtctggcgtcgtcgcggacgctggacttcgaggaggcgttcctgcgggagaccggggggtgcggggtggacgtggtgttgaactccctgacgggggagttcatcgacgcgtcgctgcggttgatgccgggcgggggtcgcttcgtcgagatgggcaaggccgacctgaggcggagcgaggaggtcgcggcactccacgagggggtccgctaccgctccttcgacctcgtcgaggcgcaccctgaccgcctccagcggatgttgctggagttggtggggttgttcgagtcgggtgtgttggtgccgttgccggtggtggagtgggatgtgcggcgggcgccggaggcgttccggttcatgagtcaggcgcggcatgtgggcaagatcgtgttgacggtgggtcggcgggtggtgggtgagggggcggttctggtcactggggggactggtggtctggggggtgtggtggcgaggcatctggtggtggagcacggggtgcgggatctggtgttggtgtcgcgtcgggggttgggggcgccgggtgcggaggagttggtggcggagctttcgggtcggggtgctcgggtggaggtggtggcgtgtgatgtgagtgatcgtgaggcgttggcgggggtggtggcggggatgtgtgcgtcgggtgtgttggcgggtgtggtgcatacggcgggtgtggtggatgacgggttggtgtcgtcgttgtcgggggagcggttgggtccggtgttggcgccgaaggtggatgcggggtggtggctgcatgagttgacgcgggggttggatctgtcgttgttcgcggtgttctcgtcgatgtcgggtctggtgggggctccggggcagggcaactacgcggcggcgaacgtgttcctggacgcgttggtggagcggcgtcggagtgaggggctgccgggcgtgtcgatggcgtggggtccgtggacccccgaggtcggcctcaccggcgccctgtccgaggccgacatgcgtcgcctggagcggtccggcatgccgccgttgtcggtggagcagggcatgcggctgttcgaccaggccgcaacagcgggcatcgcgctggtgggactcggccgggtggacgccgccgtgctgcgcggccgcgccgacctgcccctgatgctccgcgcgctggtcggcggccgggccccccgcgccgtggccggccgccagcagcagtccgggggcctcgcggggcagttggccgggctcagtgcccagcagcgcgaccagcacctgctggccctggtccgcgacaacgtcgcggtcgtcctcggccacggcggcggtcaggacgtcgatcccggccaggcgttccgcgactccggcttcgactcgctcaccgcggtcgaactgcgcaaccgcctccagagcgcgaccggcctcacactgccggccacgctcgtcttcgactaccccaacgcgacccggctcgccgccttcctgggcgagcggttcggcgacaccggcgcctccgccgccgggccggagctgcccgcgctcgtctcggtgaccgacgacccgatcgcggtcgtgggcatggcctgccgctacccgggcggcgtggagagcccggaggacctgtggaacctggtggtcgccggcggcgacgccatgacgccgttcccgctggaccgcggctgggacgtggagggcatctacgacccgacgggcacccgcccgaacaccgcggtggccaacgagggcgggttcctggcctccgccgccgacttcgacgccgggttcttcgggatctccccgcgcgaggcgctggccatggatccgcagcagcggctcctgctggaggtcgtctgggaggccctggaacgcgccgagatcgacccggccgacctcgccggcaccccggccggcgtcttcgtcggcagctaccactccagctacggggacctggtcgcccgcgcgggtgacgcgcaggcccagatgatgaccgggggcgcgcagagcgtgctgtccgggcgggtctcctacgtcctcgggctggagggcccggcggtgacggtggacaccgcgtgctcgtcgtcgctcgtcgcgatgcacctggcgagccagtcgctgcgctcgggcgagagctcgctcgcgctcgcgggcggcgtcaccatcctcgccacccccggcacgttcgtggagttcagccggcagggcgggctcgcggccgacgggcgctgcaaggcgttcgccgagtccgccgacggcaccggcttcggcgagggcgtcgggatcatggtgctggagcggctctcggacgcccgccgcaacgggcaccccgtcctcgccgtcctgcgctccagcgccgtcaaccaggacggcgcgtccaacggcctgaccgcccccaacggcccgtcccagcagcgggtcatccgccaggccctggccgccggcgggctcgccccgaccgacgtcgacgcggtggaggcgcacggcaccggcacgacgctgggcgacccgatcgaggcgcaggcgctgctggtcgcgtacggccaggaccgccccgaggaccggccgctgtggctgggcaccgtgaagtccaacatcgggcacacccaggccgccgccggtgtcgccggggcgatcaagatggtgcaggccatccggcacggcgtgctgccgagcacccggtacgccgacgagcccacctcgcacgtcgactgggaccagggccgggtgcggctgctgaccgaggaccagccctggcccgagaccggacacccgcgccgggccggcgtctcctcgttcggcatctccggcaccaacgcgcacgtcatcctggaggccgcccccgacaccgacgccgacgccgcggccgagcccggcaccggcgctgcgtccgacgccgacgccgacactgcggccgagcccggcaccgcgcccgccgcggacagcacggacggcacggacggcggcggcgacgccgagacggtctgggtggtctccggccgctcggaacaggcgctggccgcgcaggccggacggctgctgccggccgtggcggcgcaccacccggcggacgtgggcgccgcgctgctgggcacccgctcgctgttcgagcaccgggcggtcgtcgtgggcagggaccgcgaggaactgaccgccggactgcgcgcgctggccaccggcgcgccggccgcccacgtggtcgagggcgtggcccgcacccgccgcgggctcgcggtgctcttcaccggccagggcgcgcagcgcctcggcatgggccgcctgctccacgcccagtctccggtgttcgccgccgccttcgacgaggtggccgacgagttggaccggcacctggagtccccgctgcgggacgtggtctggggcggggaccaggagctgctggaccgcaccggctggacgcagcccgccctgttcgcggtcgaggtcgcgctgtaccgggtgctgctgtcctggggcatccgcccggactacctgctcggccactccatcggcgaggtggccgccgcccacgtggccggggtcttctcgctgccggacgcgtgccggctggtggccgcgcgctcccgcctgatgcaggcgctgccggccggcggggcgatggccgccgtcgaggcgaccgaggaggaggtgaccgaccggctcaccggcggggtgtccgtcgcggcggtcaacgccgccgagtcgatcgtcgtcgccggacccgaggacgaagtggccgcggtgcaggggcacttcaccgcgctcggtcggcggacccgccggctgcgggtctcgcacgccttccactccgcgctcatggagccgatgctcgacgccttcgcggcggaactggagcaactggcctacgccgagcccgccctgcccgtcgtgtcgaacgtgaccggcgcgccggcggacctggccaacccggcctactgggtcgagcaggtccgctccgcggtccggttcgccgacgggctgagctggctggtcgaccacggcgtggacaccttcgtggaagcgggcccggacgcggtgctgtccggtctggccggcgcgctgcccggggcggcctcggtggcgctccagcgcggcgaccgcgccggccgcccggtcctgctgcacgccctggcccggctccacgtgcggggcgtggccgtcgactggaccccgctgttcgccgggcgcggccggcgccgggtggagctgccgacgtacgccttccaacgccgccgctactggccgcaggccgtaccggagcaggcggccggccgcgacccggtggacgccctgttctgggagtccgtggagagcggcacgggcgagctggcccgctcgctcggcgtcgcggacgacgccctgtcgcacgtggtgccggccctgctgcgctggcgtgagcgcaggctgcgggacgcggcggccgacgactggtgctaccgccagtcctgggtgcccgtcgacggcccgcgcgccgacccggcggcgccggcgcgctggctggcggtcgtccccgagggcgacgacccctggaccggcgccgtcctgaaggcactcggccccgacgtcaccgtgctcagccccgaggccgccgacgccgaggcgctggcgcgggccggcgccgaccgcaccggcgtggtggcgctggccgccgacggcacgtccggactcaccgcggtcctgcggctggtccaggaggtgcggcgcgcggagctggccgtcccgctgtgggtggccacccgcgccgcggtcgcggcccgtcccggtgagcgggtcgagaccgtgtggcagggcggaatctgggggctcggacgcgtcgcggccctggaacttcccgacctgtggggcgggttgatcgacctgcccggcgagcccgacccggtggccctggaccggctggcgggcgtgctgtccggcggccacggcgaggaccagctcgcggtgcgcgcctccggcgtgctggcccgccggctggtgcgcgcgccgggccgcggcaccggagaggcgtggacgaccggcggcacggccctggtcaccggcggcaccggcggcctgggcggatacgtggcccggtggctggtcgagcggggcgcgcagcacctggtgctgatgtcccggcgcggcccggacgcccccggcgccgacgggctgcgggccgaactggaggccgccggcgccaaggtgagcgtcgtcgcgggcgacgtcaccgaccgggcgacgatggccgaactgctcgccggcctgcccgccgacctgccgctgcggtcggtgttccacaccgccggcgtcctgcacgagccgacacccgtcgaggcgctcagcctggagacgctgcacgacagtctcggggcgaaggtcgaaggcgccctgctgctggacgagttgaccggcgagacggacctggacgcgttcgtgctgttctcgtcgggcgcggcgtcctggggcggcagcggccagggcggttacgcggcgggcaacgcctgcctggacagcctcgcggagtaccgccgggcccgcgggcgtaccgccacctccatcgcctggggcacctgggccgaggcggggatggccgcggcgaacaccgacgagcacgactacctggtgcggctgggcgtgctgcccatgcagcccgaaccggccgtcgccgccatgcagcgcgtcctggaggaggacgcgaccacggtcaccgtctccgacatggactggtcgaggttcgcgcccgcgttctcgctggcccggccgagccggctgctcgccctgctccaggacaccggccccgccgcggccgaacccgaggccgacgccaccgcgttcgccgggcagttggcggcggtgcccgcggccgagcggcgcgagtacctcgtcaccctggtgtgcgaccacgccgccgccgtgctgggccacggcagtggcgacgaactggaccccgagaccgccttccgggacgccgggttcgactcgctgaccgcggtcgaactgcgcgaccggctccaggcgatgaccgggctgaccctgcccgccacgctcgtcttcgactaccccaacccgctcaagctcgcggccctgctggacgagacggccggcggcaccgcgggggagggcgacgaggaggagctgcgccgcgtgctggcgtccgtcccgccggccaaactccgggccgccggcctgctcgacgccgtcctcgccctggccgaggaggcgggccaggacaccggcgaggcggacggggccgacgagccggacgagaccgacctgatgaccgccgacgccgacgacctcgtccgcatcgcgctcggatccgcgtga

SEQ ID NO: 6 - protein, 3724 aa, Streptomyces sp. SN-593
MATEEQLRSYLKTAVANSREAQRQLNEIKGRRDEPLAIVGMACRYPGGVTGPDGLWDLVASGTDAVSVFPADRGWDADALYDPEGAPGTTSTREGGFVDAVADFDAGFFGISPREALAMDPQQRLLLEVAWESLEHAGIDPAGLAGTATGVFVGASSSGYMEAIGGMPETESHRMTSGLLSVISGRLSYVLGLEGPAVTVDTACSSSLVAMHWAGQALRSDECSLAIAGGVNVAVSPAGFVEFTRQGGLAPDGRCKAFAEAADGTGWSEGAGVVVLERLSDARRNGHRVLAVVRSSAVNQDGASNGLTAPNGPSQRRVIRQALASVGLAPTEVDAVEAHGTGTVLGDPIEAQALLATYGQGRPEDRPLWLGTIKSNIGHSQAAAGVASVIKMVQAIRHGVLPRTLHVDEPSKRVDWSRGRVRLLTEEQPWPETGRPRRAGVSSFGVSGTNAHLILEAAPALAPALEPAPAPAPGSAETAASASGNTAAAAAPGAAARTADDTPESGAAVSGALPWVLSARSPQALAAQAGRLLEHVEQDPRPDPADVAYSLLRSRSLFDHRAVVVGADREELTAGLRALAAGEPAAAVAEGVAEAGRHKPVFVFPGQGSQWVGMAGELRAASPVFAQALDACADALAEFVDWSLLDALDDEDLLARVDVVQPALWAVMVSLARVWESLGVRPAAVVGHSQGEIAAACVAGALSLSDGARVVALRSRAIAEELAGDGGMVAVPLPVAQAEELLARWGDRVSVAAINGPGSVVVSGVPDALDELLAHCEDTGVRAKRVPVDYASHSAAVERIERRLAADLAAVAPRSGAVPMYSTVTAEPIDTAGLDAAYWYRNLRRTVRFEDANRALAEAGYTVFVEISPHPVLTMPVQDTLGDEAVVTGTLRRHEGGPARLLLSAAHLYAHGVPVAWDGLFAGAAPAVVDLPTYAFQRRRYWPEGGTAAADVTAAGLEEVRHPLLGAVLSSPEGGGAVFTSRLSVASQPWLADHAVRGVVLFPGTGFVELVVHAADVVGCGRVRELIVEAPLVLPESGGMQVQVVMGAPEDGRRTFTVYARPDGGGDRSWVRHAAGVVEGAEAPEAAGFEPLAGAWPPPGAEALETGDVYERTAGGGFAYGPTFQGLTRAWRQDGRVFAEVALPEQQWGRAGAFGLHPALLDSVLHASLFAGLAPAEFGRLPFSFEDVVLHASGATEVRACLTPTGPDSLSVLVTDPAGGPVLSVGSLVMRPLTPQTLTAAGRRDEAVLSVEWTELPAGAEESAGPGAGSGAGLDAVLGPVAAGPDAEVPWLPGVPVHRDLADVRPEAGRPVVLAVAAQDGPVVAAAHAAARWVLEQVQTWLRDAAFAGSSLLVLTRGAVAAGATGAGGEVADLAAATAWGLVRSAQAENPGRITLVDTDPSAAVAAGPLAAALAGGEPQLALRAGRLRAPRLARADVGLVAPESGAWHLDSMAKGTLENLRLVPFPEAERALSDGEVRIEVRAAGLNFRDVLNALGMYPDPDEPMGSDVAGVVTEVGAGVTDLRAGDRVMGITNGGLGSAVVVDRRLVAPVPAGWSFATAASVPTAFLTAYYALVDLAELRSGERVLVHAGAGGVGMAALQIAGHLGAEVYSTASDGKRDLLRERGVEAARLASSRTLDFEEAFLRETGGCGVDVVLNSLTGEFIDASLRLMPGGGRFVEMGKADLRRSEEVAALHEGVRYRSFDLVEAHPDRLQRMLLELVGLFESGVLVPLPVVEWDVRRAPEAFRFMSQARHVGKIVLTVGRRVVGEGAVLVTGGTGGLGGVVARHLVVEHGVRDLVLVSRRGLGAPGAEELVAELSGRGARVEVVACDVSDREALAGVVAGMCASGVLAGVVHTAGVVDDGLVSSLSGERLGPVLAPKVDAGWWLHELTRGLDLSLFAVFSSMSGLVGAPGQGNYAAANVFLDALVERRRSEGLPGVSMAWGPWTPEVGLTGALSEADMRRLERSGMPPLSVEQGMRLFDQAATAGIALVGLGRVDAAVLRGRADLPLMLRALVGGRAPRAVAGRQQQSGGLAGQLAGLSAQQRDQHLLALVRDNVAVVLGHGGGQDVDPGQAFRDSGFDSLTAVELRNRLQSATGLTLPATLVFDYPNATRLAAFLGERFGDTGASAAGPELPALVSVTDDPIAVVGMACRYPGGVESPEDLWNLVVAGGDAMTPFPLDRGWDVEGIYDPTGTRPNTAVANEGGFLASAADFDAGFFGISPREALAMDPQQRLLLEVVWEALERAEIDPADLAGTPAGVFVGSYHSSYGDLVARAGDAQAQMMTGGAQSVLSGRVSYVLGLEGPAVTVDTACSSSLVAMHLASQSLRSGESSLALAGGVTILATPGTFVEFSRQGGLAADGRCKAFAESADGTGFGEGVGIMVLERLSDARRNGHPVLAVLRSSAVNQDGASNGLTAPNGPSQQRVIRQALAAGGLAPTDVDAVEAHGTGTTLGDPIEAQALLVAYGQDRPEDRPLWLGTVKSNIGHTQAAAGVAGAIKMVQAIRHGVLPSTRYADEPTSHVDWDQGRVRLLTEDQPWPETGHPRRAGVSSFGISGTNAHVILEAAPDTDADAAAEPGTGAASDADADTAAEPGTAPAADSTDGTDGGGDAETVWVVSGRSEQALAAQAGRLLPAVAAHHPADVGAALLGTRSLFEHRAVVVGRDREELTAGLRALATGAPAAHVVEGVARTRRGLAVLFTGQGAQRLGMGRLLHAQSPVFAAAFDEVADELDRHLESPLRDVVWGGDQELLDRTGWTQPALFAVEVALYRVLLSWGIRPDYLLGHSIGEVAAAHVAGVFSLPDACRLVAARSRLMQALPAGGAMAAVEATEEEVTDRLTGGVSVAAVNAAESIVVAGPEDEVAAVQGHFTALGRRTRRLRVSHAFHSALMEPMLDAFAAELEQLAYAEPALPVVSNVTGAPADLANPAYWVEQVRSAVRFADGLSWLVDHGVDTFVEAGPDAVLSGLAGALPGAASVALQRGDRAGRPVLLHALARLHVRGVAVDWTPLFAGRGRRRVELPTYAFQRRRYWPQAVPEQAAGRDPVDALFWESVESGTGELARSLGVADDALSHVVPALLRWRERRLRDAAADDWCYRQSWVPVDGPRADPAAPARWLAVVPEGDDPWTGAVLKALGPDVTVLSPEAADAEALARAGADRTGVVALAADGTSGLTAVLRLVQEVRRAELAVPLWVATRAAVAARPGERVETVWQGGIWGLGRVAALELPDLWGGLIDLPGEPDPVALDRLAGVLSGGHGEDQLAVRASGVLARRLVRAPGRGTGEAWTTGGTALVTGGTGGLGGYVARWLVERGAQHLVLMSRRGPDAPGADGLRAELEAAGAKVSVVAGDVTDRATMAELLAGLPADLPLRSVFHTAGVLHEPTPVEALSLETLHDSLGAKVEGALLLDELTGETDLDAFVLFSSGAASWGGSGQGGYAAGNACLDSLAEYRRARGRTATSIAWGTWAEAGMAAANTDEHDYLVRLGVLPMQPEPAVAAMQRVLEEDATTVTVSDMDWSRFAPAFSLARPSRLLALLQDTGPAAAEPEADATAFAGQLAAVPAAERREYLVTLVCDHAAAVLGHGSGDELDPETAFRDAGFDSLTAVELRDRLQAMTGLTLPATLVFDYPNPLKLAALLDETAGGTAGEGDEEELRRVLASVPPAKLRAAGLLDAVLALAEEAGQDTGEADGADEPDETDLMTADADDLVRIALGSA

SEQ ID NO: 7 - DNA, 21093 bp, Streptomyces sp. SN-593
  CDS (1)..(21090)
atgactcagtcctcggataagatcgttgaggcgctgcgcgcgtcgcttctggagaaccagcgtcttcgcaaggagcaccaggacctcgcggacgcggtgagcgagccactggcgatcgtgggcatggcctgccggttccccggtggtgtcgaggaccccgagggcctgtggcgcctggtcgccgagggaggcgacgcggtcggcggcttcccgaccgaccgtggctgggacaccgagctgctgcacgacatccccaacggcggggggttcctcgccgacgccagcgggttcgacgccgagttcttcggcatctcgccccgcgaggccctggccaccgacccgcagcagcggctgctgctggaggcgtcctgggcggcgctggagcacgcgggcctcgacccccgcaaggcggcgggcactccgaccggcgtcttcatcggcgccgcgccctacggctacagcgacgtcatgagcgggtcgtccgacgatctccagggccatgtgctgacgggcaacgctcccgccgtcgtctccggccgggtggcgtacacgctgggcctggagggtccggcggtgacggtggacacggcctgctcgtcgtcgctggtggcactgcacctggccggccactcgctgcgggccggcgagtgctcgatggcactcgtcggcggtgtgacggtgatggcgacgccgggcaccttcgtggagttcagccggcagggcggtctgtcgtccgacgggcggtgcagggcgttcgcggacgccgcggacggcaccggctggtccgagggcgtcggtgtgctggtggtggagcggctgtcggacgcacagcgcaacgggcaccgggtcctcgccgtggtgcgcgccagcgcggtgaaccaggacggcgcgtccaacggcctgacggcgccgaacggcccctcccaacagcgcgtgatccgcacggcgttggcggccgcggaactgtcgtccgccgatgtggacgtggtggaggcgcacggaaccggtacgacgctgggcgacccgatcgaggcgcaggcgctgctgtccacgtacggccaggaccgtccggaggaccggccgttgtggctggggtcgttgaagtcgaacatcggtcatacgcaggcggcggcgggtgtcgccggggtgatcaagatggtgctggcgatgcggcacggggtgctgccgcagacgttgcacgtggaccagccgagcacgcacgtggactggagccgtgggcaggtgcggctgctgacggagtcggtggcctggccggagaacggccgcccgcgccgggccggtgtgtccgcgttcgggatgtccgggacgaacgcgcacgtgatcctggaggctcccgaggtagcggccgacgccgaggccgaggtcggagtcgttccgggtgttcaggacgagccggccgcgggtgcgggtggggctgctccggtggcgtgggtggtgtcggggcgttcggcggccgcggtgcggggtcaggcgggtcgtctgctggcggctgtggagtcgtcggagtcgccggagtggtcgggttcggtggagccggtggatgtgggtgcggcgttgttgtcgcgttcgctgttcgaccaccgggcggtggtggtgggttcggggcgtgaggagttggtggccgggttgtcgtccctggcggcgggtgagccggcggggaacgtggtcgcggatggggtgcggtccggtgcgggtcgtcgggtggtgttcgtctttccgggtcagggtgcgcagtgggtgggtatggcggcggggttgttggagtcgtcgtcggtgtttcgggagtcgatggagttgtgtggggaggcgttgaggccttttgtggagtgggatttgttgggggtgttgggtgagggggatgaggtggtgttggggcgggttgatgtggtgcagccggtgttgtgggcggtgatggtgtcgttggctgcggtgtggcgttcttggggtgtggtgccgactgcggtggtggggcattcgcagggggagattgcggcggcgtgtgtggcggggggtttgtcgttgggtgatggtgcgcgggtggtggcgttgcggagtcgggcgattgcgggggcgttggcgggtaggggtgggatggtggcggtgtcgttgccggtggagggtgtgcgggggttgttgtcgggggggttgtcggtggcggtggtgaacagtcctggtggtgtggtggtggcgggtccggtggaggagttggatgcgttgttggtggtgtgtgaggagcggggggtgcgggcgcgtcgggtgccggtggattatgcgtcgcattcggtgtttgtggagttgatcgaggatcgggtgttggcggatttggcggggttggcgccggtgtcgtctggggtgccgatgtattcgtcggtgtcgggtgagcgggtggatacggcgggtttggatggggggtattggtatcggaatttgcggcagacggtggagttcgagcgggcgacgcgggcgttggcggcggatggtttctcggtgtttgttgaggtgagtccgcatccggtgttgacggtggcggtgcaggacacgttgggtgagggtgtggtggcggcggggacgttgcgtcgtcatgagggtgggttggaccggttcctgttgtcggccgcggagctgttcgtccgtggggtgccggtcgcctgggacgggttgttcgccgggcggcggacgcgtcgggtggatcttccgacgtacgccttccagcgccgccgctactggccgcagccttcgttggtggcgggggacgtggcggccgcgggtctggtgtcggcggagcatccgttgctgggtgcggtggtgtcggtgccggagtcggggacggtggtgttgacgtcgcggttgtcgttgcgggcgcagccgtggttgggggaccacgcggtgcacgggacggtgatcttcccggggacggggttcgtggagctggcgatccgcggtgcggacgccgccggcgcgggccgggtgcgcgagctgatcgtggagtcgccactggtggtgccggagcgggacagcgtccaggtgcaggtggtggtcgatgccgaggaccataccgtcgccgtctacgcccgtgcgggtgaggacgagccgtggacccggcacgccagcggctcgaccggcaccgaggccctcgccgtcgaggcgggggagttcgccggggagtggccgccggcgggcagcacgccggtcgacctggaggacttctaccagcgcagcgccgacagcgggttcggctacggcccggtcttccagggcctgacccgggcatggcggcacaacggcgacatcctggccgacattgccctcccgcaggacgagcggaccggcgcgggcgcgttcggcatccaccccgcgctgctggacgccgccctgcacccctccacgttcgccgacctcgaacccaccgagctcggccggctgcccttcgccttcaacgacgtcaccctgcacgccaccggggccacccgggtccgggcgcggatcacgcccgcgggacccgacgccgtcgccctggaactcgccgacgaggccggacaaccggtgctgtcgatcgggtccctcgtcctccggccgctcacggcgcagacgctggccggcgaggcacggcccggcgcgatgctggccctcgactgggtggaggtaccggcgcccgaggccggcgtccaggatggcgggttcaccgtcgtccgaggccccgcgggcgccacgcctgccgcggtggccacggacgacgccgattccgacgccgattccgacgccggcactgacgccgaaccgtccgacctcgtggtcctggaggtcgccccggagggcgaccaggtggtggaggccgtccacgcgacggcgaactgggtgctcggccggctccaggcgttcaccggcacgcgcatggccgtcgtgacccggggcgcggtcgccgccggcccgggcgagaccgtcaccgacctggccgcggcctcggtgtggggcctggtccgctccgcgcagaccgaggacccgggccgcttcgtgctgctcgacatcgcgccggacgccgcgccggacgccgttctcgacgccgctctggtggcccgcgcgttcgcggcggacgagccgcaactcgccctgcgcggcgaggtgttccgcagtccgcgcttcacccgggtgcccggctccgaggaggagcccgccccggtcgccctcgacggcaccgtcctggtcaccggcggcaccggtggcctgggccgcgaggtggcccggcacctggtggcccgccacggtgcgcgcgacctgctgctgctcagccgtcggggaggcgacgccgagggcgccgccgaactcgtcgaggagttggccgcccagggcgcccgggccaccgtcgccgcgtgcgacgtcgccgaccgcgaggccctggcggcggcgctcgccggcacgaagctggccggtgtggtgcacaccgcgggcatcctggacgacgggaccgtcgcgtcgctgaccgcggaccagatggaccgggtcatgcggccgaaggtcgacgccgcctggcacctgcacgagctgacccgggacgccgacctgcgcgtcttcgcggtgttctcgtcgttctccgggcagatcggcagcccggggcagggcaactacgccgcgtccaacatgttcctggacgcgctgatggaacagcgccgccaggacggcctgcccggcgtctcgatggcgtgggccgcctggacgcaggaggtgggcctgaccggaaccctgtccgaggtggacatgcgccgcatcgcgcgctccggggtgccgccgctcaccgtggaacagggcctgtcgctcttcgaccaggcgctggcggccgaccgccccgtcctcgcgctggcccggctcgacctgccacgcctgcgtgcgcagggcgaactcccggcggtcctgcgcggcctggtccccgggcccgtacgccgtgcggtggccgcgcaggaggtgcgcggcgacggcttcgcgcagcgcatggccgcgctgccggcccaggagcgcgccgcccacctgctgaccctggtgcgcgaccacgtcgcctcggtgctcggctacccgtccggcgccgacatcgacgaggccaagcccttccgggagatcggcttcgactcgctcacggccgtcgaactgcgcaaccggttgcaggccgtcaccggcctgggcctgccctcgacgctcgtcttcgactacccgaccgccgtacgcctcgcggagtacgtgggcgagcgcctcggcggggtctccgccgtcccggtcgacgcgctgccggtgctgcggtcggtcgacgacgatccactggtcatcgtgggcatgtcctgccgcttcccgggcggggtctggaacccggacggcatgtgggacctcctggcgcaggggcgggacgccatgacgcgcttccccggcgaccgcggctgggacaccggcctcctgacggagctggcccacgcgggcggcttcgtcgacggcgccatggacttcgacgcgggcttcttcgcgatgtcgccgcgcgaggcgctggcgacggacccgcagcaccgcctgctgctcgaaggctcgtgggaggcgctggagcacgccggcatcgaccccgtctcgctcgcgggctcggcgaccggtgtgttcgtcggcagctaccagtcgggctactccgaggtcgccggcgaggcgatgacggactccgacgcgaacgcgcaactgctcaccggcggtgcgcagagcgtgctgtccggccgggtggcgtacgcgctgggcctggtcggaccggcgctgacggtcgacaccgcctgctcctcctccctggtggcgctgcacctggccggtcaggcgctgcggggcggcgagtgctcgctcgccctggtggcgggcgtgacggtcaacgcgcttccgcacaccttcgtcgggttctcgcagcagggcggtctgtcggccgacggccggtgcaaggcgttcgccgaggccgccgacgggacgggcttcagcgagggcatgggggtcgtggtcgtcgagcggctgtccgacgcggagcgcaacgggcaccgggtgctggcggtcgtacgctccagcgcggtgaaccaggacggtgcgtcgaacggcctgacggcgccgaacggtccgtcgcagcagcgggtgatccgccaggcgctggcggccgcgggtctcgacgcggcggacgtggacgcggtggaggcgcacggcacgggcaccacgctgggcgacccgatcgaggcgcaggcggtgctggcgacgtacggccaggaccgtccggaggaccggccgttgtggctgggcgcggtgaagtcgaacatcggccacacgcaggcggccgcgggcgtggccggcgtgatcaagatggtgctggcgatgcggcacgggctgctgccgcagacgctgcacgtcgacgagccgagcacgcacgtggactgggagcagggccgggtgcggctgctgaccgaggccacgccgtggccggacagcggtcgtccgcgccgcgcgggtgtgtcgtcgttcgggatctcggggacgaacgcgcacgtgatcctggaagccgcccccggcacggaggccgccaccggcgcgcagacgggcatggcaaccggtaccgggacgaccggtaccgggacgaccggcaccggggcgaccggcgtggaggcggcggcgtccgcatccggagccgacacggtccccgagcacgcctccgagacggtgtgggtggtgtcggcccgtacggaggcggcgttgcgggcgcaggcggagcggctgttgtcggcgaccgaggggctggacccggcggacgtgggtgcggcgttgttgtcgcggtcggcgttcgaccatcgtgcggtggtggtgggtgcggatcgctcggaactcgtctccgggttgcgggcgttggcggccggtgaggcggcggggaacgcggtggagggtgtggcgcggagcggccgtcgggtggcggtgttgttcaccggtcagggtgcgcagcggctggggatgggccgccggctgcacggggagtcgccggtgttcgcggcggctttcgacgaggtggtggcggagttggaccggcacctcgacgttccgttgcgggaggtggtgtggggtgaggacgccgaggcgttgaactccactggttgggctcagccggcgttgttcgcggtcgaggtggcgttgttccggctgttggagtccttcagcatcacaccggactacctgttggggcactccatcggtgaggtggctgcggcttacgtcgccggggtcttcgaactggcggatgcgtgccggttggtggcggcgcgggcgcgtttgatgcaggcgcttccggcgggtggggcgatggtggccgtcgccgcttccgaggacgacgtgctgccgcttttgtcggacggcgtctctgtcgcggcggtgaacgcgccgggttcggtggtggtctccggtgaggagtccgcggtgctcgcggtcggtgagcacttcaaggcgctgggggtgaagacgacccggctgcgcgtctcgcacgccttccactcggtcctgatggagccgatgctggacgacttcctggccgcgatcgcggatgtgtcgttctccgagccgcagatcccggtggtgtcgaacctgacgggcgagccggcggacatgacgtcgccgaagtactgggcgcagcaggtgcgttcggcggtccgcttcgcggacggactggcatggctgaccgcgcacggtgtggacgccttcgtcgaggcgggaccggacgcggtgctggccggactggtggacctcaacggggccgccggcgcgaccgccgtggcactgcaacgcggcgaccgcaccggcggccaggtcgcccaccacgcggtggggcggctgtacgtccacggggtgccggtgcggtgggacgtcctcttcacgggccgcgagccccgctgggtggacctgccgacgtacgcgttccagcgccgccgctactggccgcaggcgtccctcgcgggcggcgacgtgaccgccgcgggtctggcgtcggccgaacacccgctgctgggcgcggtggtgtcggttcctgagtcggacacggtcgtgctgacctcgctgctgtcgctgcgcacgcagccgtggctggccgaccacgccgtccagggcacggtcatcctccccggcaccggcttcgtggagctggcgatccgcggtgcggacgccgtgggcgcgggcgggctgcgggagttgatcgtggaggcgccgctggtcgtccccgcctccgacagcgtccaggtccaggtcgtcgtggacggcgggaccgccgtcgtctacgcgcggcccgccggtgacgagccgtggacgcggcatgcgaccgcggtgctcggcgaggccctgcccgcgggcgcgggtgcgggtgcgggtgggtggcagtggccgccggccgacgtctcgtccgtcgacgtgtccgacttctacgaccggatggccgagggcggtttcgtctacggtccggcgttccggggtctgcggcgggtgtggcaggcggagggtgaggtcttcgcggaggtggcggtcggggaggaggagaccgatcgggcgcggaggttcggtgtgcatccggcgttgctggacgcggcgctccaggcgagtgcgtttgtggggctggatccggcgccggcgggtcggttgccgttcagcttcggtgaggtgacgctgcacgcgggtggtgcggtggcgtcgcgggtgcgggtggcgcgtacgggggcggacagcgtccgtgtggagttggcggacggcaacggtgacccggtgctgacgatcggttcgctggtgatgcggccggtggcggccgggggcgtggccggtggggtgcggtccggtgcggtgctggcggtcgactggtcgtcggtggtcgccttggacgaggcggccgggcccggggcgccccttcgggtggtgggcgccccggaggacctcgtcgtggaggatctggttccgggtgaggtcgtggtgttggaggcggtcggtacggcgggtgaggtggtgggttcggctcatgggttggctggttgggtgttggcgcaggtgcaggggtggcttggggatgagcggtgtgcggagggtcggttggtggtggtgacgcggggtgcggtgtcggcggtgccgggggaggtgttggcggatgtggcggcgtcggtggtgtggggtctggtgcgttcggcgcaggcggagaatccggggcggatcgtcctgctcgacctcgaccagcgggcctccgccgtggacgcgggcctggtcgcgggggtggtggccgctggtgagccgcaagcggtcgtgcgcgacggtgtggtgcgggccgcgcgcttggtccgtgtcgcggctgcggctgacggggacgcggggggagaggtgggctttggtgcgggcacggtgctggtgacgggtggtacgggtgggctgggccgtgaggtggcgcgtcacctggtggcggtgcacggtgtgcgggatctgctgctgctgaaccgtagtggtggcggcgccgaactcgtggcggagctggcggagttgggtgcgcgggcgcgtgtggtcgcgtgtgacgtcgcggatcgtgtggcgctggcggaggtgcttgcgggtgtgcgtctgacgggtgtggtgcacacggctggtgtggtggatgacggtctggtgtcgtcgttgaccgtcgagcggttggatcgggtgttggcgccgaaggtggatgcggcgtggtatttgcacgagttgacggcggggatggatctgtcggcgttcgtggtgttctcgtcgttggccggtgtggtgggtagtccggggcaggggaactacgcggcgggcaatgtgttcttggacgcgttgatgcagtatcggcggctggaggggttgccggcggtgtcgatggcctggggtccgtgggcccaaggtgcgggtctgacgggtgagttgtcggatgtcgacatgcggcggatcgccgcgtcgggaacgccgccgttcacggtggagcagggtctggcggtgttcgacgcggctctgggcagtccggaggcggccgtcgccctgacccggctcgacctcgcggcactgcggacccgcgacgaactgcccccgctgtggcgcaccctggtcgggcaaccggcccggcgcgccgccggcgaccaccgcgccgcccccgacgacctcgcgcaccgcctcgcgggccgttccctcgccgaccgcgaggaggacctgctggccctggtcgccgaccacgtggcggcggtgctcgggtacgcctcccgcgagcagatcgacaccgcccaggcgttccgggacatgggcttcgactcgctcagcgccatcgagctgcggaaccggctccaggccgcgacgggactcaccgtcccggccacgctggtcttcgactacccgaacgcgcggcgcctcgcggcctacctcgccgagcagttcggcgacgccccgcgcgggtcggcggtggccctgccaccgctcgtctccgtggacgacgacgcgctcgtcatcgtcggcatggcctgccgcttcccgggcggggtccgggacatcgacggcttctggcagctcgtcgccaacggcggcgacggcatgtcccccttccccgccgaccgcggctgggacctggaggcgctgtacgacccggcgggcgaccgctcgggcacctccgccacccgcgagggcggcttcctggacgacgcgctcgacttcgacgccggcttcttcggcatctcgccccgcgaggcgctcgtcaccgacccgcagcagcggctgctgctggagacgtcgtgggaggcgctggagcacgccgggatcgcccccgagcggctggccggcagcagcaccggcgtcttcgtcggcagctaccagtccggctacagcgaggtcatcggcgacgccctcgacgaggccgagccgcagatgctcaccggcaacgcccagagcgtgctgtccggccgggtggcgtacacgctgggtctcgaaggtcccgcggtgacggtggacacggcctgctcgtcgtccctggtggcgctgcactgggcgggccaggcgctgcgcgcgggggagtgctccctcgccctggtcggcggcgtgaccatgatggccaccccgagcaccttcgtcagcttctcccagcagggcggcgtcgcgtcggacggacgctgcaaggcgttcgcggacggtgcggacggcaccggctggtccgagggcgtcggtgtgctggtggtggagcggttgtcggacgcggagcgcaacgggcaccgggtgctggcggtcgtacgcgccagcgcggtgaaccaggacggcgcgtcgaacggcctgacggcgccgaacggcccctcccaacagcggctgatccggcaggcgttggcggcggccgggctcaactccggtgacgtggacgccgtggaggcgcacggcacgggcacgtccctgggcgacccgatcgaggcgcaggcggtgctggcgacctacggccaggaccggccggaggaccggccgctgtggctgggcgcggtgaagtcgaacatcggtcatacgcaggcggcggcgggtgtcgcgggcgtgatcaagatggtgctggcgatgcggcacggggtgctgccgcagacgttgcacgtggacgagccgagcacgcacgtggactggagccagggtcaggtgcggctgctgaccgaggccacgccgtggccggagaacggccgcccgcgccgggccggtgtgtcgtccttcggtatctccgggacgaacgcgcacgtgatcctggaggctcccgaggttgaggccgaggccgaggccgaggtcggagtcgttccgggcgttcaggacgagccggccgcgggtgcgggtggggctgctccggtggcgtgggtggtgtcggggcgttcggcggccgcggtgcggggtcaggcgggtcgtctgctggcggctgtggagtcgtccgggtcggcgggttcggtggagccggtggatgtgggtgcggcgttgttgtcgcgttcgctgttcgaccaccgggcggtggtggtgggttcggatcgtgagcaactggtgtcgggtgtgcgggcgttggcggcgggtgagccggccgggaacctggtgggcggcgctgccggcggtggtcaggagcgtcgggtggtgttcgtcttcccgggtcagggtgcgcagtgggtgggtatggcggcgggtctgctgaattcctcgtcggtgtttcgggagtcgatggagttgtgtggggaggcgttgaggccttttgtggagtgggatttgttgggggtgttgggtgagggggatgaggtggtgttggggcgggttgatgtggtgcagccggtgttgtgggcggtgatggtgtcgttggctgcggtgtggcgttcgtggggtgtggtgccggctgcggtggtggggcattcgcagggggagattgcggcggcgtgtgtggcggggggtttgtcgttgggtgatggtgcgcgggtggtggcgttgcggagtcgggcgattgcgggggcgttggcgggtaggggtgggatggtggcggtgtcgttgccggtggagggtgtgcgggggttgttgtcggggggtgtgtcggtggcggtggtgaacagtcctggtggtgtggtggtggcgggtccggtggaggagttggatgcgttgttggtggtgtgtgaggagcggggggtgcgggcgcgtcgggtgccggtggattatgcgtcgcattcggtgtttgtggagttgatcgaggatcgggttcttgatgatctggcggggttggcgccggtgtcgtctggggtgccgatgtattcgtcggtgtcgggtgagcgggtggatacggcgggtttggatggggggtattggtatcggaatttgcggcagacggtggagttcgagcgggcgacgcgggcgttggcggcggatggtttctcggtgtttgttgaggtgagtccgcatccggtgttgacggtggcggtgcaggacacgttgggtgagggtgtggtggcggcggggacgttgcgtcgtcatgagggtgggttggaccggttcctgttgtcggccgcggagctgttcgtgcacggcgttcccgtgacgtggaacggtctgttcgcggaccggaagccgcgtcgggtggatcttccgacgtacgccttccagcgccgccgctactggccgcagcagtcctcggcggtcggcgacgccgccctgcgcgacccggtggacgcggagttctgggcgtcgatgcagagcaccgacgtctccgacctcgcgcgctccctcggcgtggacagcaccacgctgtcggacgtggtgcccgccatgctgcggtggcgcgaccagcggcagtccgagtcgcaggcggacggctggcgctaccgcgagacgtgggcacccgtgtccgccaccggccgccccctcgacccgtccgccgcgcgctgggcggtgatcgtgcccgagggacacgccgacgacccgtggtcggcggccgtggccgaggccgtcggcggcgagctgatcgaggacgacggctccgccccggagctgagccccgcctgccccggcgtgctgtcgctgctgtcggcccgggacgacgtcgagggactgctgtccaccgtccggctggtccagcacctgcgggccccggtgtgggcggtcacgcgcggcgccgtcgccgtacgccccgaggagcgtgtcagcggggtctggcagggcgccacgtggggcatcgggcgggtggccgccctggagctgtccgagcggtgggccggtctgctggacctgcccgacgtgatcgacgacgcggtgcgggagcggctgcgcaccgtggtcgcgggcgggcacggagaggaccaggtggccgtccggtcgtccgggctgttcgcccggcgcctggtccacgccgcggcgcccacgctgcccgcttcctggcggaccagcggcacggcgatcgtgaccggcggtaccggcggggtcggcgcgcacgtggcgcgctggctggtccgggtcggcgccgagcacgtggtgctcgtcagccggcgcggcccggccgcggacggcgcccgggagctgagcgccgaactcgaagcggcgggcgcccgggtgagcgtggtcgcgggtgacgtgggcgaccgcgacaccctcgcggagctgatcgcctccgtcccggcggaactgccgctgcgcagcgtcctgcacgcggccggcgtggtggacgaggccggggccgtggagaccctcaccgcggaggcgctccaggcgcagctacgggtcaaggtcgccggcgggctgctgctcgacgaactcacccaggacctggagctggacgcgttcgtcctcttctcctcgggggcggctgcctggggcagcgcgggccagggcagctacgccgcggcgaacgcctgcctcgacgccctggccggacaccgccgggcccggggcctgacggcgctgtccgtggcgtggggcgcctgggacgcgccgggcatgatggcggcggacgccgactacgcccagtacctggagcggctcggcgtccacccgatgcagccggaggcggcggtcgccgccctgcaccgggcgctcagcgacggcgacaccaacgtcacggtcacgaacatggactggtcgcgcttcgttccggcgttcggcatggcccgtcccagccgcctgttctcgctgctgccggaggcggctgccaccgccgacccggaggagcaggaggagggcgtcgaccacctgcggtccatgaccgcgcgggagcgccgcgaccacctgctcgcggcggcccgcgaccacgcggccgccgtgctcggctacgactcgggcgaccaggtcgacgccgcccaggcgttcaaggaactgggcttcgactcggtcaccgcggtggagttccgcaaccgcctccagaccgtcaccgggctgagcctgccgaccaccctcgtcttcgactaccccaacgccgggcggatcgcggactacctggccgagcgtttcggcgacacgtcggcgcaggccgaggacgcgctgccggcgctggtggccgggagcaccgacgacccgatggtgatcgtgggcatggcctgccgcttccccggcggggtgaacaacccggccgacctgtggcgggtcgtcacggacggcgtcgacgtgatgtccggcttcccggacgaccgcggctgggacctcgacgcgctgtacgacccgaacggcgagcgcgccggctcctcggtcacccgggagggcggcttcctggaggacgcgggcggcttcgacgcgggcttcttcggcatctccccgcgtgaggcgatggcgacggacccgcagcagcggctggtgctggaggcgtcctgggaggcgttggagcacgcgggcatcgacccggccgcgctggccgggaccgccactggagtcttcatcggcgccgcgccgtccggttacagcgaggtcgccggcgcgaccccggaggcccaggggcacctgctgaccggcggtctgctgagcgtgctgtcgggccgggtggcctacaccctcggcctccagggccccgcggtcagcgtggacacggcctgctcgtcgtccctggtggcgctgcactgggccgggcaggcgctgaactcgggggagtgctccctcgcgctggtcggcggggtggcggtcatggccacgcccggcgggttcgtggagttcagccgccagggcggcctcgccgccaacggccgcgtgaaggcgttcgcggaggcggcggacgggaccgcgtggtccgagggcgtcggcgtcgtggtcgtcgagcggctgtcggaagcccggcgcaacgggcaccgggtgctcgcggtggtgcgctccagcgcggtgaaccaggacggtgcgtcgaacggcctgacggcgccgaacggcccgtcgcagcagcgggtgatccgccaggcgctggcggcggcctccctggcaccgtccgatgtggacgtggtggaggcgcacggcacgggcacgacgctgggcgacccgatcgaggcgcaggcgctgctggcgacctacggccaggggcggccggaggaacggcccctgctgctggggtcgttgaagtcgaacatcggtcacacgcaggcggccgcgggtgtggccggcgtgatcaagatggtgctcgcgatgcagaacggggtggtgccccgcacgctgcacgtggacgcgccgtcctcgcaggtcgactggtccgcgggcagcgtcgaactggtcaccggtgagatggcctggccggagagcggtcgtccgcgccgggcgggtgtgtcgtccttcggtgtctcggggacgaacgcgcacgtgatcctggaggcggcgcctggggtggaggtcgaggccgaggtcgaggcgcgggtcgaggtcgcgggagaggctggggccgagtccgagtccgagtccgagtccgggtcggggtcggtgtgggtggtgtcgggtcgttcggagggggcgttgcgggcgcaggcggagcggttgttgtcggtggccgaggggctggatccggtggatgtgggtggggcgttgttgtcgcggtcggtgttcgagcaccgtgcggtggtggtgggcagtgggcgtgaggaactgacggcggggttgcgggcgttggcggccggtgaggcggcgggcaacgcggtggagggtgtggcgcggagtggtcgtcgggtggcggtgttgttcgcgggtcagggtgcgcagcggctggggatggggcgccggctgcacggggagtcgccggtgttcgcggcggctttcgacgaggtggtggcggagttggaccggcacctcgacgttccgctgcggggggtggtgtggggtggggacgcggatgcgttgaattcgacgggttgggcgcagccggcgttgttcgcggtcgaggtggcgttgttccggctgttggagtcgttcggtatcacaccggattacctgctggggcactccattggtgaggtggcggccgcgcatgtggccggggtgttcgatctggcggatgcgtgccggttggtgggggcgcgggcgcgtttgatgcaggcgcttccggtgggtggggcgatggtggcggttgccgcgccggaggaggaggtgctgccgcatctgtccgacggggtctctgtcgcggcggtgaacgcgccgggttcggtggtggtctccggtgaggagtccgctgtgctcgcggtcggtgagcatttcaaggcgttgggggtgaagacgacccggctgcgggtgtcgcacgccttccattcggcgttgatggagccgatggtggacgacttcctggcggcgatcgcggatgtgtcgttctcggagccgcggattgcggtggtgtcgaatctgacgggtgagccggcggatatgacgtcgccgaagtactgggcgcagcaggtgcgttcgggggtgcggttcgcggacggtgtggcgtggttggccgcgcagggtgtggacgtgttcgtggatgcgggtcctgatggtgtggtggcgggtctggcgcaggcgaacgcgtcggatgcggtggcggtggcgttgatgcgcaaggaccgtgagggtctggccatggcgttgctggccgcgggtgacctgttcgtgcacggggtgccggtggagtgggtcggactgaccggcgggcgggggtcggagtgggtcgagctgccgacgtacgccttccagcgccgccgctactgggcgcaaccgaagcccgtcggtgatgtggcggctgcgggtctggtgtcggcggagcatccgttgctgggtgcggtggtgtcggtgccggagtcggggacggtggtgttgacgtcgcggttgtcgttgcgggcgcagccgtggttgggggatcacgcggtgcacgggacggtggtcttcccgggggcggggttcgtggagttggcgatccgcggtgcggacgcggtgggtgcgggtggtctgcgggagttggtcgtggaggcgccgttggtggttcccgcggtcggcagtgttcaggtgcaggtggtggtcggagacggtgggtccttgacggtgtacgcgcgtgccgcggacgaggagccgtggacacggcatgcgaccgcggtgctcggcgatgccctgcccgcggacgtggttgcgggtgggtggcagtggccgccggccgacgcctcgtccgtcgacgtctcggacttctacgagctgacggccgaccacggtttcgtctacggtccggcgttccggggtctgcgccaggtgtggcaggcggagggtgaggtctttgccgaggtggcggtcggggaggaggagaccgatcgggcgcggaggttcggtgtgcatccggcgttgctggacgcggcgctccaggcgagtgcgttcgtggggctggatccggcgccggcgggtcggttgccgttcagcttcggtgaggtgacgctgcacgcgggtggtgcggtggcgtcgcgggtgcgggtggcgcgtacggggccggacagcctgcgcgtcgaactggccgacggcaacggtgatccggtgttgacgatcggttcgctggtgatgcggccggtggcggccgggggcgtggtcggcggcgcgcaggcgggtgcggtgctggcggtcgactggtcatcggtggtcacgctgccggaggtggacgcgggcgcggacacgggcacgggcacggacgcgggcatgtctgtgggcgtggatgggggtgtggcggtgttccgggctccggaggatgtggttccgggtgaggtcgtggtgttggaggcggtcggtacggcgggtgaggtggtgggttcggctcatgggttggctggttgggtgttggcgcaggtgcaggggtggcttggggatgagcggtgtgcggagggtcggttggtggtggtgacgcggggtgcggtgtcggcggtgccgggggaggtgttggcggatgtggcggcgtcggtggtgtggggtctggtgcgttcggctcaggcggagaatccggggcggatcaccttgctggaccttggtgccggtgagggggtcgggtccgtggaccgtgctgtggtggtcggggcggtggcttccggtgagccgcagctcgtggtccgcgatggtgtggtgcgggccgcgcgcttggtccgtgtcgcggctgcggctgacggggacgcggcggggtcggtgggctttggtgcgggcacggtgctggtgacgggtggtacgggtggtctgggccgtgaggtggcgcgtcacctggtggcggtgcacggggtgcgggatctgctgctgctgaaccgtagtggtggcggcgccgaactcgtggcggagctggcggagttgggggcgcgggcgcgtgtggtcgcgtgtgacgtcgcggatcgtgcggcgctggccgaggtgttggccggtgtcgccctgaccggggtggtgcacacggccggtgtcgtcgaggacgcggtgatcacctccctggacaccgagcggttggatcgggtgttggcgccgaaggtggatgcggcgtggtatctgcacgagttgacggcggggatggatctgtcggcgttcgtggtgttctcgtcgttggccggtgtggtgggtagtccggggcagggcaactacgcggcgggcaacgtgttcctggacgcgttgatgcagtatcggcggctggaggggttgccggcggtgtcgatggcctggggtccgtgggcccaaggtgcgggtctgacgggtgagttgtcggacgcggacatgcggcggatcacggcgtcgggaacgccgccgttcacggtggagcagggcctggcggtgttcgacgcggccctgggcagcccggaggcggccgtcgccctgacccggctcgacctcgcggcactgcggacccgcgacgaactgcccccgctgtggcgcaccctggtcgggcagccggcccggcgtgccgccggcggacaccgcaacgaccccgacgacctggcccgccggctggccgcgctgcccgacgccgatgcgcgggacgcgtacctgctgcggctcgtcgccgaccacgtggccctcgtcctcggtcacgcgccgggtgacggggtggacaccacgaaggagttccgtgagctcggcttcgactcgctgacctccgtcgacctgcggaaccgcctccaggcgaccaccggcatgtccctgccggcgacgctcgtcttcgaccacccggacgccgccaccctggccgccttcctcagtgcgaggttcggcgacgccggcccggccgccgccgagccggaggcggtcgcccccagggacccgatgcaggacctctatctcaacgcgctggagagcggccgcgccgacctcggtgacgcgttcgcgctcagtgccgcgcggttgcgcccgcggtacgccgatgccaccgcgctggagcggcggccggtgccggtgcggctgtcggccggggacaccggtccgcacctggtctgcgtctgcccgccgctggcactgaacggaccgcagacctacaaccggttcgcggccgaactggccgccgactggaaggtctcggccctggtggccccgggcttcgcggcggacgccccgctgccggagaacagccgggtgctgatcgcgacgctggccgacgcggtgcaggagtacgtcggcgactccgcgttcgcgctggccggcctgtcctccggcggcgtgctcgcccacgagatcgcgcgggaactggagcgccggggcagcgacccgctggcggtggtgctcctcgactcgtatcccatggacagcccggtgctgaagcggtggaagaacgagatggcccgggtcggcctggagcgcgcccgcgccctggaccggcgccaggccgacgaggggttccggctggaggagatcaccgcctcggcctggatctgcggggaactgctgctcgactggcggccggagggactgacggcgccctcctgcctggtccgcgccagcgagccggtggtggccgaggacggcgccggctggcagacgccggtcgccgcgtcggaggtcatcgacgtgccgggcgaccacttcagcatcatggaccggcagttcgcggcctccaccgcggccgccgtgcgcgcgtggctggcgggggtgaccgcccgggtcggttag

SEQ ID NO: 8 - protein, 7030 aa, Streptomyces sp. SN-593
MTQSSDKIVEALRASLLENQRLRKEHQDLADAVSEPLAIVGMACRFPGGVEDPEGLWRLVAEGGDAVGGFPTDRGWDTELLHDIPNGGGFLADASGFDAEFFGISPREALATDPQQRLLLEASWAALEHAGLDPRKAAGTPTGVFIGAAPYGYSDVMSGSSDDLQGHVLTGNAPAVVSGRVAYTLGLEGPAVTVDTACSSSLVALHLAGHSLRAGECSMALVGGVTVMATPGTFVEFSRQGGLSSDGRCRAFADAADGTGWSEGVGVLVVERLSDAQRNGHRVLAVVRASAVNQDGASNGLTAPNGPSQQRVIRTALAAAELSSADVDVVEAHGTGTTLGDPIEAQALLSTYGQDRPEDRPLWLGSLKSNIGHTQAAAGVAGVIKMVLAMRHGVLPQTLHVDQPSTHVDWSRGQVRLLTESVAWPENGRPRRAGVSAFGMSGTNAHVILEAPEVAADAEAEVGVVPGVQDEPAAGAGGAAPVAWVVSGRSAAAVRGQAGRLLAAVESSESPEWSGSVEPVDVGAALLSRSLFDHRAVVVGSGREELVAGLSSLAAGEPAGNVVADGVRSGAGRRVVFVFPGQGAQWVGMAAGLLESSSVFRESMELCGEALRPFVEWDLLGVLGEGDEVVLGRVDVVQPVLWAVMVSLAAVWRSWGVVPTAVVGHSQGEIAAACVAGGLSLGDGARVVALRSRAIAGALAGRGGMVAVSLPVEGVRGLLSGGLSVAVVNSPGGVVVAGPVEELDALLVVCEERGVRARRVPVDYASHSVFVELIEDRVLADLAGLAPVSSGVPMYSSVSGERVDTAGLDGGYWYRNLRQTVEFERATRALAADGFSVFVEVSPHPVLTVAVQDTLGEGVVAAGTLRRHEGGLDRFLLSAAELFVRGVPVAWDGLFAGRRTRRVDLPTYAFQRRRYWPQPSLVAGDVAAAGLVSAEHPLLGAVVSVPESGTVVLTSRLSLRAQPWLGDHAVHGTVIFPGTGFVELAIRGADAAGAGRVRELIVESPLVVPERDSVQVQVVVDAEDHTVAVYARAGEDEPWTRHASGSTGTEALAVEAGEFAGEWPPAGSTPVDLEDFYQRSADSGFGYGPVFQGLTRAWRHNGDILADIALPQDERTGAGAFGIHPALLDAALHPSTFADLEPTELGRLPFAFNDVTLHATGATRVRARITPAGPDAVALELADEAGQPVLSIGSLVLRPLTAQTLAGEARPGAMLALDWVEVPAPEAGVQDGGFTVVRGPAGATPAAVATDDADSDADSDAGTDAEPSDLVVLEVAPEGDQVVEAVHATANWVLGRLQAFTGTRMAVVTRGAVAAGPGETVTDLAAASVWGLVRSAQTEDPGRFVLLDIAPDAAPDAVLDAALVARAFAADEPQLALRGEVFRSPRFTRVPGSEEEPAPVALDGTVLVTGGTGGLGREVARHLVARHGARDLLLLSRRGGDAEGAAELVEELAAQGARATVAACDVADREALAAALAGTKLAGVVHTAGILDDGTVASLTADQMDRVMRPKVDAAWHLHELTRDADLRVFAVFSSFSGQIGSPGQGNYAASNMFLDALMEQRRQDGLPGVSMAWAAWTQEVGLTGTLSEVDMRRIARSGVPPLTVEQGLSLFDQALAADRPVLALARLDLPRLRAQGELPAVLRGLVPGPVRRAVAAQEVRGDGFAQRMAALPAQERAAHLLTLVRDHVASVLGYPSGADIDEAKPFREIGFDSLTAVELRNRLQAVTGLGLPSTLVFDYPTAVRLAEYVGERLGGVSAVPVDALPVLRSVDDDPLVIVGMSCRFPGGVWNPDGMWDLLAQGRDAMTRFPGDRGWDTGLLTELAHAGGFVDGAMDFDAGFFAMSPREALATDPQHRLLLEGSWEALEHAGIDPVSLAGSATGVFVGSYQSGYSEVAGEAMTDSDANAQLLTGGAQSVLSGRVAYALGLVGPALTVDTACSSSLVALHLAGQALRGGECSLALVAGVTVNALPHTFVGFSQQGGLSADGRCKAFAEAADGTGFSEGMGVVVVERLSDAERNGHRVLAVVRSSAVNQDGASNGLTAPNGPSQQRVIRQALAAAGLDAADVDAVEAHGTGTTLGDPIEAQAVLATYGQDRPEDRPLWLGAVKSNIGHTQAAAGVAGVIKMVLAMRHGLLPQTLHVDEPSTHVDWEQGRVRLLTEATPWPDSGRPRRAGVSSFGISGTNAHVILEAAPGTEAATGAQTGMATGTGTTGTGTTGTGATGVEAAASASGADTVPEHASETVWVVSARTEAALRAQAERLLSATEGLDPADVGAALLSRSAFDHRAVVVGADRSELVSGLRALAAGEAAGNAVEGVARSGRRVAVLFTGQGAQRLGMGRRLHGESPVFAAAFDEVVAELDRHLDVPLREVVWGEDAEALNSTGWAQPALFAVEVALFRLLESFSITPDYLLGHSIGEVAAAYVAGVFELADACRLVAARARLMQALPAGGAMVAVAASEDDVLPLLSDGVSVAAVNAPGSVVVSGEESAVLAVGEHFKALGVKTTRLRVSHAFHSVLMEPMLDDFLAAIADVSFSEPQIPVVSNLTGEPADMTSPKYWAQQVRSAVRFADGLAWLTAHGVDAFVEAGPDAVLAGLVDLNGAAGATAVALQRGDRTGGQVAHHAVGRLYVHGVPVRWDVLFTGREPRWVDLPTYAFQRRRYWPQASLAGGDVTAAGLASAEHPLLGAVVSVPESDTVVLTSLLSLRTQPWLADHAVQGTVILPGTGFVELAIRGADAVGAGGLRELIVEAPLVVPASDSVQVQVVVDGGTAVVYARPAGDEPWTRHATAVLGEALPAGAGAGAGGWQWPPADVSSVDVSDFYDRMAEGGFVYGPAFRGLRRVWQAEGEVFAEVAVGEEETDRARRFGVHPALLDAALQASAFVGLDPAPAGRLPFSFGEVTLHAGGAVASRVRVARTGADSVRVELADGNGDPVLTIGSLVMRPVAAGGVAGGVRSGAVLAVDWSSVVALDEAAGPGAPLRVVGAPEDLVVEDLVPGEVVVLEAVGTAGEVVGSAHGLAGWVLAQVQGWLGDERCAEGRLVVVTRGAVSAVPGEVLADVAASVVWGLVRSAQAENPGRIVLLDLDQRASAVDAGLVAGVVAAGEPQAVVRDGVVRAARLVRVAAAADGDAGGEVGFGAGTVLVTGGTGGLGREVARHLVAVHGVRDLLLLNRSGGGAELVAELAELGARARVVACDVADRVALAEVLAGVRLTGVVHTAGVVDDGLVSSLTVERLDRVLAPKVDAAWYLHELTAGMDLSAFVVFSSLAGVVGSPGQGNYAAGNVFLDALMQYRRLEGLPAVSMAWGPWAQGAGLTGELSDVDMRRIAASGTPPFTVEQGLAVFDAALGSPEAAVALTRLDLAALRTRDELPPLWRTLVGQPARRAAGDHRAAPDDLAHRLAGRSLADREEDLLALVADHVAAVLGYASREQIDTAQAFRDMGFDSLSAIELRNRLQAATGLTVPATLVFDYPNARRLAAYLAEQFGDAPRGSAVALPPLVSVDDDALVIVGMACRFPGGVRDIDGFWQLVANGGDGMSPFPADRGWDLEALYDPAGDRSGTSATREGGFLDDALDFDAGFFGISPREALVTDPQQRLLLETSWEALEHAGIAPERLAGSSTGVFVGSYQSGYSEVIGDALDEAEPQMLTGNAQSVLSGRVAYTLGLEGPAVTVDTACSSSLVALHWAGQALRAGECSLALVGGVTMMATPSTFVSFSQQGGVASDGRCKAFADGADGTGWSEGVGVLVVERLSDAERNGHRVLAVVRASAVNQDGASNGLTAPNGPSQQRLIRQALAAAGLNSGDVDAVEAHGTGTSLGDPIEAQAVLATYGQDRPEDRPLWLGAVKSNIGHTQAAAGVAGVIKMVLAMRHGVLPQTLHVDEPSTHVDWSQGQVRLLTEATPWPENGRPRRAGVSSFGISGTNAHVILEAPEVEAEAEAEVGVVPGVQDEPAAGAGGAAPVAWVVSGRSAAAVRGQAGRLLAAVESSGSAGSVEPVDVGAALLSRSLFDHRAVVVGSDREQLVSGVRALAAGEPAGNLVGGAAGGGQERRVVFVFPGQGAQWVGMAAGLLNSSSVFRESMELCGEALRPFVEWDLLGVLGEGDEVVLGRVDVVQPVLWAVMVSLAAVWRSWGVVPAAVVGHSQGEIAAACVAGGLSLGDGARVVALRSRAIAGALAGRGGMVAVSLPVEGVRGLLSGGVSVAVVNSPGGVVVAGPVEELDALLVVCEERGVRARRVPVDYASHSVFVELIEDRVLDDLAGLAPVSSGVPMYSSVSGERVDTAGLDGGYWYRNLRQTVEFERATRALAADGFSVFVEVSPHPVLTVAVQDTLGEGVVAAGTLRRHEGGLDRFLLSAAELFVHGVPVTWNGLFADRKPRRVDLPTYAFQRRRYWPQQSSAVGDAALRDPVDAEFWASMQSTDVSDLARSLGVDSTTLSDVVPAMLRWRDQRQSESQADGWRYRETWAPVSATGRPLDPSAARWAVIVPEGHADDPWSAAVAEAVGGELIEDDGSAPELSPACPGVLSLLSARDDVEGLLSTVRLVQHLRAPVWAVTRGAVAVRPEERVSGVWQGATWGIGRVAALELSERWAGLLDLPDVIDDAVRERLRTVVAGGHGEDQVAVRSSGLFARRLVHAAAPTLPASWRTSGTAIVTGGTGGVGAHVARWLVRVGAEHVVLVSRRGPAADGARELSAELEAAGARVSVVAGDVGDRDTLAELIASVPAELPLRSVLHAAGVVDEAGAVETLTAEALQAQLRVKVAGGLLLDELTQDLELDAFVLFSSGAAAWGSAGQGSYAAANACLDALAGHRRARGLTALSVAWGAWDAPGMMAADADYAQYLERLGVHPMQPEAAVAALHRALSDGDTNVTVTNMDWSRFVPAFGMARPSRLFSLLPEAAATADPEEQEEGVDHLRSMTARERRDHLLAAARDHAAAVLGYDSGDQVDAAQAFKELGFDSVTAVEFRNRLQTVTGLSLPTTLVFDYPNAGRIADYLAERFGDTSAQAEDALPALVAGSTDDPMVIVGMACRFPGGVNNPADLWRVVTDGVDVMSGFPDDRGWDLDALYDPNGERAGSSVTREGGFLEDAGGFDAGFFGISPREAMATDPQQRLVLEASWEALEHAGIDPAALAGTATGVFIGAAPSGYSEVAGATPEAQGHLLTGGLLSVLSGRVAYTLGLQGPAVSVDTACSSSLVALHWAGQALNSGECSLALVGGVAVMATPGGFVEFSRQGGLAANGRVKAFAEAADGTAWSEGVGVVVVERLSEARRNGHRVLAVVRSSAVNQDGASNGLTAPNGPSQQRVIRQALAAASLAPSDVDVVEAHGTGTTLGDPIEAQALLATYGQGRPEERPLLLGSLKSNIGHTQAAAGVAGVIKMVLAMQNGVVPRTLHVDAPSSQVDWSAGSVELVTGEMAWPESGRPRRAGVSSFGVSGTNAHVILEAAPGVEVEAEVEARVEVAGEAGAESESESESGSGSVWVVSGRSEGALRAQAERLLSVAEGLDPVDVGGALLSRSVFEHRAVVVGSGREELTAGLRALAAGEAAGNAVEGVARSGRRVAVLFAGQGAQRLGMGRRLHGESPVFAAAFDEVVAELDRHLDVPLRGVVWGGDADALNSTGWAQPALFAVEVALFRLLESFGITPDYLLGHSIGEVAAAHVAGVFDLADACRLVGARARLMQALPVGGAMVAVAAPEEEVLPHLSDGVSVAAVNAPGSVVVSGEESAVLAVGEHFKALGVKTTRLRVSHAFHSALMEPMVDDFLAAIADVSFSEPRIAVVSNLTGEPADMTSPKYWAQQVRSGVRFADGVAWLAAQGVDVFVDAGPDGVVAGLAQANASDAVAVALMRKDREGLAMALLAAGDLFVHGVPVEWVGLTGGRGSEWVELPTYAFQRRRYWAQPKPVGDVAAAGLVSAEHPLLGAVVSVPESGTVVLTSRLSLRAQPWLGDHAVHGTVVFPGAGFVELAIRGADAVGAGGLRELVVEAPLVVPAVGSVQVQVVVGDGGSLTVYARAADEEPWTRHATAVLGDALPADVVAGGWQWPPADASSVDVSDFYELTADHGFVYGPAFRGLRQVWQAEGEVFAEVAVGEEETDRARRFGVHPALLDAALQASAFVGLDPAPAGRLPFSFGEVTLHAGGAVASRVRVARTGPDSLRVELADGNGDPVLTIGSLVMRPVAAGGVVGGAQAGAVLAVDWSSVVTLPEVDAGADTGTGTDAGMSVGVDGGVAVFRAPEDVVPGEVVVLEAVGTAGEVVGSAHGLAGWVLAQVQGWLGDERCAEGRLVVVTRGAVSAVPGEVLADVAASVVWGLVRSAQAENPGRITLLDLGAGEGVGSVDRAVVVGAVASGEPQLVVRDGVVRAARLVRVAAAADGDAAGSVGFGAGTVLVTGGTGGLGREVARHLVAVHGVRDLLLLNRSGGGAELVAELAELGARARVVACDVADRAALAEVLAGVALTGVVHTAGVVEDAVITSLDTERLDRVLAPKVDAAWYLHELTAGMDLSAFVVFSSLAGVVGSPGQGNYAAGNVFLDALMQYRRLEGLPAVSMAWGPWAQGAGLTGELSDADMRRITASGTPPFTVEQGLAVFDAALGSPEAAVALTRLDLAALRTRDELPPLWRTLVGQPARRAAGGHRNDPDDLARRLAALPDADARDAYLLRLVADHVALVLGHAPGDGVDTTKEFRELGFDSLTSVDLRNRLQATTGMSLPATLVFDHPDAATLAAFLSARFGDAGPAAAEPEAVAPRDPMQDLYLNALESGRADLGDAFALSAARLRPRYADATALERRPVPVRLSAGDTGPHLVCVCPPLALNGPQTYNRFAAELAADWKVSALVAPGFAADAPLPENSRVLIATLADAVQEYVGDSAFALAGLSSGGVLAHEIARELERRGSDPLAVVLLDSYPMDSPVLKRWKNEMARVGLERARALDRRQADEGFRLEEITASAWICGELLLDWRPEGLTAPSCLVRASEPVVAEDGAGWQTPVAASEVIDVPGDHFSIMDRQFAASTAAAVRAWLAGVTARVG

SEQ ID NO: 9 - DNA, 1224 bp, Streptomyces sp. SN-593
  CDS (121)..(1221)
gggccaggacaccggcgaggcggacggggccgacgagccggacgagaccgacctgatgaccgccgacgccgacgacctcgtccgcatcgcgctcggatccgcgtgaaggagctgtacgacatggacatcaccgcagcagtgatcgaggaggccgggtcccccttcgtcctgaagcaggtcgaactggccgaccccggcccggacgaggtgctggtcgagctgcacgccaccgggctgtgccacaccgacctggccgtccagcacgggttcacgcccttcccgctgcccggcgtgctgggccacgagggcagcggcgtggtgcgcgcggtggggccgggcgtcctcggcctcgcggccggcgaccacgtggcgctgtcgttcgcgagctgcggcgagtgcggcaactgccgggacaaggtgccctcctactgcgacaccttcgtcgcccggaacttcatgggcgcccgcatcgacggcacccggccgctgtcgctggacggcgcgggactcggctcgaacttcttcggccagtcgagcttcgcctcgcacaccgtggcgcacacccgctccgtggtgaagatccccgccgaggtcccgctgccgctggccgcgcccctgggctgcggtgtgcagaccggcgccggggcggtgctcaactcgctccaggtcaccgcgggcagctcggtgctggtgctcggcggcggctcggtcggcctcagcgccgtgatgggcgcggtgctcgccggcgccgagaccgtcatcgtcgtcgagccgctggagtcgcggcggctggtcgccaaggacctcggcgcgacccacgtcctggaccccgaggacggcgggatcgccgagcaggtccgcggcatcgtgccgcagggcgtgcggtacgcggtggacaccaccgccaagtccgcggtgctcgccgaggtcgtccaggccatggccaagcggggccgcgtcgccctgctgggcatcccctccgaacccaccgccgtgctcccgctgagcctcgggctgagccagatcctcgggctgagcgtcgtcggcgtcgtcgagggcgacagcgacccgcacacgttcatcccctggctgctcgaccagtacctccagggccggttccccctcgaccgcctcgtcaccacgctgccgttcgccgacatcaacgaggcggccgcggcgcaggtgcgcggggacgcgatcaaggtggtgctcacgcaccggtga

SEQ ID NO: 10 - protein, 367 aa, Streptomyces sp. SN-593
MDITAAVIEEAGSPFVLKQVELADPGPDEVLVELHATGLCHTDLAVQHGFTPFPLPGVLGHEGSGVVRAVGPGVLGLAAGDHVALSFASCGECGNCRDKVPSYCDTFVARNFMGARIDGTRPLSLDGAGLGSNFFGQSSFASHTVAHTRSVVKIPAEVPLPLAAPLGCGVQTGAGAVLNSLQVTAGSSVLVLGGGSVGLSAVMGAVLAGAETVIVVEPLESRRLVAKDLGATHVLDPEDGGIAEQVRGIVPQGVRYAVDTTAKSAVLAEVVQAMAKRGRVALLGIPSEPTAVLPLSLGLSQILGLSVVGVVEGDSDPHTFIPWLLDQYLQGRFPLDRLVTTLPFADINEAAAAQVRGDAIKVVLTHR

SEQ ID NO: 11 - DNA, 1572 bp, Streptomyces sp. SN-593
  CDS (121)..(1569)
cgcggcgcaggtgcgcggggacgcgatcaaggtggtgctcacgcaccggtgaccgggcccgccccggcgcgcacgagttggcaacccccgacgaggacaggctaaggacaggcgaggcccatgcccatcgaccaccaccacttctacatcggcggcgaccgggtcgcacccggcaccgggcaccgcatccaggtgcacgccgccgccaccggagaactcgtcggcagcgtgccggaggcccacccggcggacgtggacgcggccgtcgccgccgcccgcgccgccttcgacgacccctcggggtggcggcagtggaccccgcaggcccgcgcggagacgctgacccgtttcgcggcggctctcaaggagcgtgctcccgagatcgcccggctggtcagcgtgcagaacggcatgccgatcagcctggccggcctgctggagggcaccgcgccctcggcgctgctgcgctactacgccgcggtggccgccgcgaagacgggcgacgaccgccgccccggcctgttcggcgggcacgcggtcgtcgtccccgaaccggtgggcgtcgtcgccgcgatcgtcccctggaacgtgccccagggcatcaccttcatgaagctcgcccccgccctggccgcgggctgctccgtggtgctcaagccgtccccggagaccgtgctcgacgcctaccaggtcgccgaggccgccgcggaggccggactgcccgcggggctgctcaacatcgtgcccggcggcgcggagaccggccgctacctcgtcggccaccccggcgtggacaaggtgtccttcaccggctccaccgccaccggccggagcatcgccgagacctgcgggcggctgctgcggccggtctccctggagctgggcggcaagtccgccgcggtcgtcctggacgacgcggacctcagcggcgtgatggaccgcttcttccgggccacgctgctgaacaacgggcaggtctgctggctgggcaccaggatcctggcgccccgctcccgctacgccgaactggtcgacgccgtcaccgagatggcgcgcgcgctcaaggtcggcgacccgctcgaccccgcgacccagctcggcccgctggtctccgagcggcagcgggaccgggtggagtcctacatcgccaagggcgtcagcgacggcgcccgcctcaccgtcggcggcggccgccccgcgtgggccgaccgcggctggtacgtcgacgcgaccgtcttcgccgacgtggacaacaggtccgccatcgcgcaggaggagatcttcggcccggtgctgtcggtcatcccctacaccgacgaggacgaggccctggcactcgccaacgacagcgactacgggctcggcggctcggtgtggaccaccgacgccgaccgcggcctggacttcgcccgccgggtgcagaccggctcgatcggggtcaacagctacgccaacgacccggtcgcgcccttcgggggccgcaaggcgagcggcctcggctacgaactgggccccgagggcctcgcccagtaccaggtcctgaagtcgatctacgtcgaccagcaggtctga

SEQ ID NO: 12 - protein, 483 aa, Streptomyces sp. SN-593
MPIDHHHFYIGGDRVAPGTGHRIQVHAAATGELVGSVPEAHPADVDAAVAAARAAFDDPSGWRQWTPQARAETLTRFAAALKERAPEIARLVSVQNGMPISLAGLLEGTAPSALLRYYAAVAAAKTGDDRRPGLFGGHAVVVPEPVGVVAAIVPWNVPQGITFMKLAPALAAGCSVVLKPSPETVLDAYQVAEAAAEAGLPAGLLNIVPGGAETGRYLVGHPGVDKVSFTGSTATGRSIAETCGRLLRPVSLELGGKSAAVVLDDADLSGVMDRFFRATLLNNGQVCWLGTRILAPRSRYAELVDAVTEMARALKVGDPLDPATQLGPLVSERQRDRVESYIAKGVSDGARLTVGGGRPAWADRGWYVDATVFADVDNRSAIAQEEIFGPVLSVIPYTDEDEALALANDSDYGLGGSVWTTDADRGLDFARRVQTGSIGVNSYANDPVAPFGGRKASGLGYELGPEGLAQYQVLKSIYVDQQV

SEQ ID NO: 13 - DNA, 942 bp, Streptomyces sp. SN-593
  CDS (121)..(939)
aggtcctgaagtcgatctacgtcgaccagcaggtctgagtggcgcccggtgcccctttcccggcaccgggcggccaccccacaggtagtgacatgcagtgagaaacggagtggacgactcatgacgcgacgactcgacggtaaggtggccatgatcacgggtgcggcccgtggccagggccggggccacgccctgcggctggccgaggagggcgccgacctgatcctggtggacatctgccagaacatcgacacgctggcctactccctcggctccgaggacgagctcgccgagaccgccgcccaggtggagaagctgggccgccgcgtggtgacggcgcaggccgacacccgggacgcggcggcgctgcgggaggccgtcgagcgcggcacctcggagctgggcggcctggacatcctcgtcgccaacgccggcgtgggcatggcgcacccctcgaccagccaggagcaggcgttccgcgaccagttggagatcaacaccatcggcgcatggaacaccgtgcacgccgcggcgccgaagatcatcgagggcggcaagggcggcgcggtcgtcgtcatcagctcggtgatgggcctgagcggcaagatcggcagcccgaccggcggcgcggagggctacgtcgccgccaagcacgcgctgctgggcctgtcccgggcgtggacccggtggctgggcccgcacaacatccgggtcaactccatccacaccaccggggtgcgcaccccgctgctcatcaacgacgccgtcaagaaggtgcacaccaagccccccaccaccggcgccgaggtgggccacatcctcgacgtcacgatgctggacgtcagcgacgtcaccggcgcggtgtcctggctggtctcggacgaggcccgctacgtcaccggtatcgcgctgccgatcgacgccggcttcaccaccccgtaa

SEQ ID NO: 14 - protein, 273 aa, Streptomyces sp. SN-593
MTRRLDGKVAMITGAARGQGRGHALRLAEEGADLILVDICQNIDTLAYSLGSEDELAETAAQVEKLGRRVVTAQADTRDAAALREAVERGTSELGGLDILVANAGVGMAHPSTSQEQAFRDQLEINTIGAWNTVHAAAPKIIEGGKGGAVVVISSVMGLSGKIGSPTGGAEGYVAAKHALLGLSRAWTRWLGPHNIRVNSIHTTGVRTPLLINDAVKKVHTKPPTTGAEVGHILDVTMLDVSDVTGAVSWLVSDEARYVTGIALPIDAGFTTP

SEQ ID NO: 15 - DNA, 1644 bp, Streptomyces sp. SN-593
  CDS (121)..(1641)
ctcaaggtggcgggcgacatcgcctggaagagcgagatgatggtccgcggtccgcggtccatgccggtgggatggtgacggcgcgcacggccggccggccggtgcaggcggggagggtccgtggctgagcacgtcgatgtcctcgtcgtcggggcgggactgtccgggatcggcgccgccggccggttgcggcgcgcggacccgcggcggacgctggcgatcctggaggcgcgggacgccgtcggcgggacgtgggacctgttccggtacccgggggtgcggtcggactcggacatgcacaccctgggctaccagcagcgcccgtggaaggacccgaaggcgatcgccgacggggagagcatcctgtcctacatccgggagaccgcccgggaggacggcctgctggaccacgtccgcttccggcaccgggtggtcggcgcggactgggacgaggcgcacgcccgctggaacgtgcgggtggagcggggcgcggagggcgaggccgaggagatcacgctgacctgctccttcctctacctgtgctcgggctactaccgctacgacgagggctacagcccgcagttcaaggacgccgaccggttcggggggcggatcgtgcacccccagcactggcccgcggacctggactacaccggcaagcgcgtcgtcgtcatcggcagcggcgccacggcggtcaccctggtgcccgcgatggccgcacgggccgcgcacgtcacgatgctccagcgctcgccctcctacgtgatgtcgctgccctcccgggacggcatcgcgggcgcgctgcgccgggtgctgcccgagcgcaccgcgctggccgcgatccggtggaagaacgcgacgctggcgctgggcttctaccggttcagccgcaagcgccccgagaaggtgaaggcgatgctgcgcaagggcgtcgtcaagcagctcccggacggctacgacgtcgacacccacttcaccccgcggtacgcgccgtgggaccagcgggtgtgctacgtgccggacggggacctgttcaaggcgatcagcgccggggaggcgtcggtcgtcaccgaccacgtggagtccttcaccgagaggggcctcctgctgcgctcgggcaaggaggtgcccgcggacgtggtcgtcacggcgaccggtctgaacctgctgccgcttggcggcatccggctgagcgtggccggccggccggtcgacccgggcgcgacggtcgcctacaagggcatgatgctctccggggtgccgaacttcgcctggacgctgggctacaccaacagctcgtggacgctgaaggccgacctcgtcgcgcagtacgtgtcccggctgctggcgcacatggccgagcgcggccacgccgtggtgcggccgctggccccgccggccggggacgaagtgctgccgatcctggacctgcggtccggctacgtgctgcgcggcgcggacaccatgccgaagcggggcacgcgcgcgccgtggaccctggagcagaactaccggcaggacgtccggctgctttggcgcggtccggtggacgacgccgtggagttcgccccggcgccctccggcgcccgggccgccggctccggggacgccccggcgcgtccggtgccggagacgagttcctga

SEQ ID NO: 16 - protein, 507 aa, Streptomyces sp. SN-593
MAEHVDVLVVGAGLSGIGAAGRLRRADPRRTLAILEARDAVGGTWDLFRYPGVRSDSDMHTLGYQQRPWKDPKAIADGESILSYIRETAREDGLLDHVRFRHRVVGADWDEAHARWNVRVERGAEGEAEEITLTCSFLYLCSGYYRYDEGYSPQFKDADRFGGRIVHPQHWPADLDYTGKRVVVIGSGATAVTLVPAMAARAAHVTMLQRSPSYVMSLPSRDGIAGALRRVLPERTALAAIRWKNATLALGFYRFSRKRPEKVKAMLRKGVVKQLPDGYDVDTHFTPRYAPWDQRVCYVPDGDLFKAISAGEASVVTDHVESFTERGLLLRSGKEVPADVVVTATGLNLLPLGGIRLSVAGRPVDPGATVAYKGMMLSGVPNFAWTLGYTNSSWTLKADLVAQYVSRLLAHMAERGHAVVRPLAPPAGDEVLPILDLRSGYVLRGADTMPKRGTRAPWTLEQNYRQDVRLLWRGPVDDAVEFAPAPSGARAAGSGDAPARPVPETSS

SEQ ID NO: 17 - DNA, 1314 bp, Streptomyces sp. SN-593
  CDS (121)..(1311)
atcgcgaactacggcgccaacctcgtgtccgtcgtcgacctcacccgggtctgacccgccggcgcccggcccgcgggcggcaccgcccgcgacccgcatctccccgctgaggagcactcattgaacacgacctacccggagtcgctgtcctacccgttcggccctgacgaaggtctcgcgctgagcgagtcgtacaccagggcgcgcgacaccgacggcctgatccgcgtcaagctgccctacggagaaccggcctggctggccacccgctacgaggacgcccggctcgtgctgggcgacgcgcgcttcagccgcgcgctgtccgaggagcacgacccgccgcgggcacggaagttcaacgcgcaggcgaagtccatgttcaacatggacgcgcccgaccacacccggctgcgccggctgatcagcaaggcgttcaccatccgccgggtggaggagctgcggccgaaggtccacgacctggcccaccggctcatcgacgacatgctggccaagggcgagccggcggacctggtggcggactacgcgctgccgatcccgacgaccgtcatctgcgagctgctcggcgtccccttcgaggaccgggagaagttcggcaggtggaccgacgccatcctgtcgaccagcacgctgaaccccgaggagggccgggtcaagcgcatggagctggtcggctacatcggcgggatcatcgcggcccgccgcgcacagccggccgacgacctcatctcgggcatgatcgaggcccgcgacgtgcaggacaagctcaccgagcaggagttgctggaccactgcatcggcctgctcatcgccgggcacgagaccaccgcctcccagatccccagcttcgtctacgccctgctggaccagccgcagcactggaagcggctgctggacgacccggagctgatcccgtcggccgtcgaggagctgttccgcttcgtgccgctgggcagcggctcggccgccccgcgctacgcccgggaggacatcgaggtcggcgggacgctggtgcgcgccggcgaaccggtcctggtggccctcggcgcggccaaccgcgacgggctgcgcttcgaggaccccgaggagatcaagctcgaccgcccgagcaaccaccacatcggcttcggccacggcatccaccactgcctcggcgccccgctggcccggctggagttgcaggaggcgctgcgcgcgctcctggagcggctgccgaccctcaaggtggcgggcgacatcgcctggaagagcgagatgatggtccgcggtccgcggtccatgccggtgggatggtga

SEQ ID NO: 18 - protein, 397 aa, Streptomyces sp. SN-593
MNTTYPESLSYPFGPDEGLALSESYTRARDTDGLIRVKLPYGEPAWLATRYEDARLVLGDARFSRALSEEHDPPRARKFNAQAKSMFNMDAPDHTRLRRLISKAFTIRRVEELRPKVHDLAHRLIDDMLAKGEPADLVADYALPIPTTVICELLGVPFEDREKFGRWTDAILSTSTLNPEEGRVKRMELVGYIGGIIAARRAQPADDLISGMIEARDVQDKLTEQELLDHCIGLLIAGHETTASQIPSFVYALLDQPQHWKRLLDDPELIPSAVEELFRFVPLGSGSAAPRYAREDIEVGGTLVRAGEPVLVALGAANRDGLRFEDPEEIKLDRPSNHHIGFGHGIHHCLGAPLARLELQEALRALLERLPTLKVAGDIAWKSEMMVRGPRSMPVGW

SEQ ID NO: 19 - DNA, 1131 bp, Streptomyces sp. SN-593
  CDS (121)..(1128)
cgacagcacgctacccgccggattttccgcataagcagatccgtcgaatccacgagacattttccgacgacctcccgtcagcgggcgcgcgccggcagtcgccgtgaggagagcacatccgtgaccgagaccgaacagctcgacgtcccgcacgtggaggtcaccatcccggtgggcgaggggccctccgcggtcgccctcaccccggacggcacccgggcgtacgtgacgaactacgggcggtgggcgacccactcccccggtgacacggtgtcggtgatcgacaccgccacccacgaggtcgtcgcgaccgtgaaggtcggcgtcgggcccaccgcgctggaggtcgtccccgacggctcccgggtctacgtcgtcaactacggctccggcaaggagccgggccacaccgtctcggtcatcgacaccgccacccacgaggtcgtggccaccgtcgaggtcggcaactcccccgacggcgtcgcggtcacgcccgacggccggcgggtctacatctccgaactgggctccgaggccaaccccggcaacaccatgtcggtcatcgacaccgccaccttcgaggtggtcggcaccgtcgacgtgggggcggcgcccggcgcggtggcgatccacgaggacggcgtgcacgcctacgtggtcaactacggcaagccgaccgagaccgagggcaccgtctccgtcatcgacatcgcgacgaacacggtggtcaccaccgtgaccgtgggccggtcgcccggcgccgtcgccatcaccccggacggcgcccacgcctacgtcgccgaccacggaccgttcggcgaccccgggaacacggtgtcggtcatcgacacccgcacccacgaggtggcgtccgtcatcacggtcggccccggccccggcggggtggcgatctcccccgacggcacccgcgcctacgtcgtgaacatgggtggcaacacggcccccggcaggacgatgtccgtgatcgacaccgccacgcggacggtcgtcaacaccgtcgccgtcgagcgcactcccgccggcatcgccgtgtccgcggacggccgccgggcctacatcgcgaactacggcgccaacctcgtgtccgtcgtcgacctcacccgggtctga

SEQ ID NO: 20 - protein, 336 aa, Streptomyces sp. SN-593
VTETEQLDVPHVEVTIPVGEGPSAVALTPDGTRAYVTNYGRWATHSPGDTVSVIDTATHEVVATVKVGVGPTALEVVPDGSRVYVVNYGSGKEPGHTVSVIDTATHEVVATVEVGNSPDGVAVTPDGRRVYISELGSEANPGNTMSVIDTATFEVVGTVDVGAAPGAVAIHEDGVHAYVVNYGKPTETEGTVSVIDIATNTVVTTVTVGRSPGAVAITPDGAHAYVADHGPFGDPGNTVSVIDTRTHEVASVITVGPGPGGVAISPDGTRAYVVNMGGNTAPGRTMSVIDTATRTVVNTVAVERTPAGIAVSADGRRAYIANYGANLVSVVDLTRV

SEQ ID NO: 21 - DNA, 1053 bp, Streptomyces sp. SN-593
  CDS (121)..(1050)
agattaggggccccgtccacacgccgtcgaagggcttaggggattgctaggggggtgttgtcgccccgtccttcagtaggttcgtgccccgagaaggcgtcgcatgggatggggagtaacgtgaagatcgcataccttgtcgatgggggtctgagcgatctgccaggcgccggcacggatctctacgagcgctacccgcaggtccaggagatctacgagaaggccgccggctggaccgggctgaccgtcgaccggatgctgcgctgggaactggaccgcctggaggagtaccagcaggtcgggctgatccgccaggcctcgatcatcctcggcgtcgccgacctgctcgccgagcgcggcgtgcgccccgacgtcatcgccggcatgagcctcggctcgctggtgggcgcctgcatcgcgggcgccgtcgagcgcaaggacctgttcaccttcctgcgccggaagaccgaggtgcccccgcccaccggccccgcccagggatgcgccggcctgctggtgccggtggacgccgacgacgaggagtacctcggccagctcgtcgagggcacctgggtcggcggcgagctcggcctgcgccgcaacggcaccgtccgcggcttcatggtctccgggtacgtcgacgccctccacgagctgatggccaagctcccggaggggtcgatgcacatgatcaaggacgtgaacgtcgccgtgcacgtccccgcctgcgccgaccagaacgaatacctcgaaccggtctggtcgaagatgaatttccacgacccggagattccgctgtgttcctgcaaggagcgcggaatgctcaccaccgcggcggacgtacggaaatggtacctgggaaaccaggtcgacaaggtgagccatcccgacatgttctccaacgtgatcggccacgaaccccagcttgcgttcctcctcggcccggccaagctcgacatctacctcgacgcactgccgtgcccggtcattcagatcgagaacgacgaacagctcacggacgccatgaccgccctgtacgaaatgcggatctga

SEQ ID NO: 22 - protein, 310 aa, Streptomyces sp. SN-593
MKIAYLVDGGLSDLPGAGTDLYERYPQVQEIYEKAAGWTGLTVDRMLRWELDRLEEYQQVGLIRQASIILGVADLLAERGVRPDVIAGMSLGSLVGACIAGAVERKDLFTFLRRKTEVPPPTGPAQGCAGLLVPVDADDEEYLGQLVEGTWVGGELGLRRNGTVRGFMVSGYVDALHELMAKLPEGSMHMIKDVNVAVHVPACADQNEYLEPVWSKMNFHDPEIPLCSCKERGMLTTAADVRKWYLGNQVDKVSHPDMFSNVIGHEPQLAFLLGPAKLDIYLDALPCPVIQIENDEQLTDAMTALYEMRI

SEQ ID NO: 23 - DNA, 1194 bp, Streptomyces sp. SN-593
  CDS (121)..(1191)
tcgacgcactgccgtgcccggtcattcagatcgagaacgacgaacagctcacggacgccatgaccgccctgtacgaaatgcggatctgatcgctgtctcccccagaaaggcgcgccaggcatgaacgaatcactggctctggtcgaccagttcctgcagaccgacctcgacgagtggacccggcaggtggtccgacggcacttcgaccccggaaccggcagcccctactggctcaagcgcgcggcggagctggacttcgacccgctggagatcacccgctacgacgagctgagcgcgctcgggccgttcccgctgtccgtgctgcgcaagctcgaccccgccgacctggttccccaggcggtgccgcggccgatcgccggccgggtcttcgactccggcggcaccaccggcgaccccaagcgcatcctgtacacgcccgccatgctccagcaccggcaggcgtggcggcactggtcgttccacaccgagggcttccgccccgacggcaactgggtgcagggcacccccaccggaccgcacgtgatcggcctcggcgtccaggaactgtcgtcctacggcgggcggatgtacatcgtcgacatcgacccgcggtgggtcaagcggctcatccgcgccggcaagctcgccgaggccgacgagtacaccgaccacgtcctcggccagatcaccaacatccttgccagccagccgatcgactacctcaacaccacgtcggccctgctcaccgccctcatccggcgcgccccggagctggccgcgaagctcaagggcgtacgggtcagcggcacccactgcaccccggccatgttccgcacgttcaaggagaccctcaacggcggcagcggcgccatcgtggggcgcagctacggcaacaccttcggcacctcggccggcatcccggacgaggacgacggcgagatcctgccgtacctgccgaactaccccaacgtcaccgcccgcgtggtcgacaagcaggactggacccgcgaggtcgggttcggcgagcagggccaggtcatgctgaacgtcctgcaccccgacctgctcctgcccaacttcctcgaacgggaccaggccgtccggtacgacaccggcgccgcctacccctgcgacggcgtcgccaacgtcatgcccctccagatcaccaggaacgccccggagggcatctactga

SEQ ID NO: 24 - protein, 357 aa, Streptomyces sp. SN-593
MNESLALVDQFLQTDLDEWTRQVVRRHFDPGTGSPYWLKRAAELDFDPLEITRYDELSALGPFPLSVLRKLDPADLVPQAVPRPIAGRVFDSGGTTGDPKRILYTPAMLQHRQAWRHWSFHTEGFRPDGNWVQGTPTGPHVIGLGVQELSSYGGRMYIVDIDPRWVKRLIRAGKLAEADEYTDHVLGQITNILASQPIDYLNTTSALLTALIRRAPELAAKLKGVRVSGTHCTPAMFRTFKETLNGGSGAIVGRSYGNTFGTSAGIPDEDDGEILPYLPNYPNVTARVVDKQDWTREVGFGEQGQVMLNVLHPDLLLPNFLERDQAVRYDTGAAYPCDGVANVMPLQITRNAPEGIY

SEQ ID NO: 25 - DNA, 1083 bp, Streptomyces sp. SN-593
  CDS (121)..(1080)
cgccaccggcgcggcccgcagcggaaccgcgcccgcgggacggggaggcggaaccgcacacacggactcgaaggaggaacgggaagcggccccgccggggcactgcggcccctgacacccatgcaagcgatcgtcatcgaggacaagcagctcgtgctgcgcgaggtcgaggaccccaggcccggaccgggcgaggtggtcgtcgacgtggccgcggccggtgtcaaccgggccgacgtctcccagcggcagggcctgtacccgccgccgccgggcgccgcgccctacccggggctggaggtctcgggcgtggtcagcgccctcggcatcggggtgaaggggcgccgggtcggcgacgaggtcgcctgcctgctggccggcggcggctacgccgagcgggtcgcggtacccgccgcgcacaccctgccggtgccggccggggtgtccctgcgggacgcggcggccctgcccgaggtcgcctgcacggtctggtccaacgtggtcgaccgcgacgccctgcgggagggcgagacgctgctggtccacggcggcggcagcggcatcggcaccttcgcgatccaactgggcaaggcactgggcgcgtcggtagtggtgaccgcccgcgcggccaagcacgaccggctgcgggccctcggcgcggacctcgcggtcgactacaccaccgaggacttcgtgctggccacgaaggagttcacctccggtgccggcgccgacgtcatcctcgacatcatcggcgcgaagtacctcgcggacaacgtcgaggccctcgccccgaacggccggatcaccgtcatcggcctccagggcggccgcaaggccgaactggacctcgcgctgctgctcaaccggcgcggttcggtctcggcgacgtcgctgcgcgcccggccgcgggccgacaagtcgcgcatcgtcgccggagtcgagcgggaggtgtggcccctggtcgaggcgggcaccgtcaagccggtcgtgcacaccgccctgccgctggccgaggcggccgaggcgcaccgcctgatcgaggcgagcgaccacgtcggcaagatcctcctgctgccgtaa

SEQ ID NO: 26 - protein, 320 aa, Streptomyces sp. SN-593
MQAIVIEDKQLVLREVEDPRPGPGEVVVDVAAAGVNRADVSQRQGLYPPPPGAAPYPGLEVSGVVSALGIGVKGRRVGDEVACLLAGGGYAERVAVPAAHTLPVPAGVSLRDAAALPEVACTVWSNVVDRDALREGETLLVHGGGSGIGTFAIQLGKALGASVVVTARAAKHDRLRALGADLAVDYTTEDFVLATKEFTSGAGADVILDIIGAKYLADNVEALAPNGRITVIGLQGGRKAELDLALLLNRRGSVSATSLRARPRADKSRIVAGVEREVWPLVEAGTVKPVVHTALPLAEAAEAHRLIEASDHVGKILLLP

SEQ ID NO: 27 - DNA, 1038 bp, Streptomyces sp. SN-593
  CDS (121)..(1035)
taccgaggagcccgcccggcgacgacaccgcaccgccccccacctgccccgcgccggcccccacctcggccggcgctcgctcgcatcgtcggcacagacgatgccggaacggagttcccgatgccactcgaccccgcggtcaaggccgtcctcgacatccttgacgccgccggcgacaggcagctgcacgagctgccgatgcccctcgcgcgggcgaactatgaccaactcgccgggctcggcggcgaaccggcggcgatcggccgcaccgagcgcaccaccgccgacggggtgccggtccggctgtactggccggacagcccgggcccgcacccgatcctgctcttcttccacggcggcggctgggtgctcggcagcctcgacgggtacgacggcgtggcccgcgacctgagcgcgcacgccgactgcctggtggtcagcgtcggctaccgcctcgcccccgaccactgcttccccgccgcggtcgaggacgccctcaccgtcgccaagtgggcgatgcggacgggcgacgcgtacggcggcgacacccagcggctggcggtggccggcgactcggcgggcggcaacctcagtgccgtgctcgtcaacgaactgcccggccggttccgggcgcaggcgctgctctaccccgtcaccgaccagactaggaagcacccctcggtccgcgagaacgggcagggctacctgctcaccgaggacaccctgcgctggttcagcgagaactacctcggcgaccaggacccgcgccacccgtgggcgtcgccgctgttcgccgccgacgaggtgctcgcggccgcgcccccgaccctcgtggtcaccggcgagttcgacccgctgcgcgacgagggcgaggcctacgccgaccggctgcgcgcgctcggcgtccacgtcgagaaccgccgctacgacggcatgatccacgccttcttctccatgcgcgggatggtgccggccgccggcgaggccctgcgccaggtgacggacttcctccaggaagcctggacgcaacacacgtga

SEQ ID NO: 28 - protein, 305 aa, Streptomyces sp. SN-593
MPLDPAVKAVLDILDAAGDRQLHELPMPLARANYDQLAGLGGEPAAIGRTERTTADGVPVRLYWPDSPGPHPILLFFHGGGWVLGSLDGYDGVARDLSAHADCLVVSVGYRLAPDHCFPAAVEDALTVAKWAMRTGDAYGGDTQRLAVAGDSAGGNLSAVLVNELPGRFRAQALLYPVTDQTRKHPSVRENGQGYLLTEDTLRWFSENYLGDQDPRHPWASPLFAADEVLAAAPPTLVVTGEFDPLRDEGEAYADRLRALGVHVENRRYDGMIHAFFSMRGMVPAAGEALRQVTDFLQEAWTQHT

SEQ ID NO: 29 - DNA, 780 bp, Streptomyces sp. SN-593
  CDS (121)..(777)
atggtaaggttggcgaccagtcggcgatccgccggaggcggcccagggggcccggcgccgaccgccgcgacccgtgcgggagcccgtcaggagagggagcagcaggtgaccagcacgcgcatgaagggagtcgccgcgcggctccacgtcggcgcccggatccgccacgccctgtgggtcggcgagatcgtccccgggcagcggctggtggaacaggacctggccgaccggctggaggtcacccgcagctccgtccgcgaggcgctgctcgacctcgcctcggacgacctggtggagctggtgcccaaccgcggcgcccggatcagggtggtctcggtcgaggaggccgtccagatcaccgagtgccgctccgcgctggagcggctgtgcgcgcgcaaggcggccgagcgcgtcaccccggagcagcgcgccgcgctggccgaggtcggcgagcaactgcgcacggcggtcgcggaaggagcgctggaggcgtactccaccctcaaccgcaggctgcacgacctgatcatcgagttcagcggccaggccgtcgcccggcgccagctcgaacggctcaacacgcagatggtgcgcttccagttccggctggccatgcggcccggccggcctcaggagtcgctgccgcaactgctggccatcgtggacgccgtcggctccggcgaccccgacgccgccgacaaggccgccgaggcgcagctggccggcgtcatcgcgcagttgcgggcgagcgatcccccggccgccctgagcggatggtag

SEQ ID NO: 30 - protein, 219 aa, Streptomyces sp. SN-593
MKGVAARLHVGARIRHALWVGEIVPGQRLVEQDLADRLEVTRSSVREALLDLASDDLVELVPNRGARIRVVSVEEAVQITECRSALERLCARKAAERVTPEQRAALAEVGEQLRTAVAEGALEAYSTLNRRLHDLIIEFSGQAVARRQLERLNTQMVRFQFRLAMRPGRPQESLPQLLAIVDAVGSGDPDAADKAAEAQLAGVIAQLRASDPPAALSGW

SEQ ID NO: 31 - DNA, 1422 bp, Streptomyces sp. SN-593
  CDS (121)..(1419)
caccggccatcgccccccgcccctgccgtcttcgccgccggccgcccctggagggccctgccggcacccaccgctttcgaccgaatccgaccggccttcaacggagaatccggaaccacgatgagcgagaccgtcacgatagacgcgccgcccgcggcgcccaaaccccctaccccgttctaccgggacctggccgtccaggtcctcgcaggcgtcgcgctgggcgtcctggtgggcaactacgccccctctgtcgggcggcacacgcagttcctcggcgacatcttcatccacctgatccagatggtcgtcgggctgatcatcttctgcacggtgacccacggcatcgcgagcgtgcgggacctggggaaggtcggccggatcgcggtccgggcgctggtgtacttcgaggtgatcaccaccgcggccctgatcatcgggctggtcgtggtcaacgtgctgcacccgggctcgggagtgcacatcgacctgtcgcacaacggcggggccggcaccgcgccggccaagtccgagggcttcgacgacttcctggtcggcctggtccccacctcggcggtgcaggcgttcgcccagggcgacatcctccaggtgctggtgttctcggtgctgttcgcctgcggactggcctcgctgggcgagcggagcgcgccggtgctggaactggtcggcaccgtccagaagacgctgttctggatcatcggcaaggtgatgcggatcgcgcccctggcggccttcggcgccatcggctacaccgtctccaagtacggcctgggcacgctcacttcgctgggcaagctgatcggcgtcttctacctgatcgtgctcctcttcttcctcctcgtcctgtggccggtctcccggtacgccggggtcagcctgctgaaggtgctgcgctacttccgcgcggaactgctgctggtgctgggcaccagctcgtcggagagcgtcttcccgcagctcacgtcgaagctggagcggctgggcgtcgagcagtcggtggtcggcctggtgctgccgaccgcgtacagcttcaaccacgacggcacgtgcctgtacttcgcctcggtgagcgtcttcctcgcccaggccaccggtaccgacctgggctggcaggcgcagatcggcctgctgctcatcctgctgctcacgtccaagggcggggcgggggtctccggctcggcgatcgccgtgctggcgctgacgctcagctccacgcacaagatccccgtggacagcatcgcgctggtgctgggcatccacagcatcctgtcggccgcgttcgtgttcaccaacatcgcggggaactgcgtggccacgctggtggtcggcaagtgggagaacgccatcgaccgggtccggctgcacaaggaactcgacgccgggttcacgaccgccgcgtga

SEQ ID NO: 32 - protein, 433 aa, Streptomyces sp. SN-593
MSETVTIDAPPAAPKPPTPFYRDLAVQVLAGVALGVLVGNYAPSVGRHTQFLGDIFIHLIQMVVGLIIFCTVTHGIASVRDLGKVGRIAVRALVYFEVITTAALIIGLVVVNVLHPGSGVHIDLSHNGGAGTAPAKSEGFDDFLVGLVPTSAVQAFAQGDILQVLVFSVLFACGLASLGERSAPVLELVGTVQKTLFWIIGKVMRIAPLAAFGAIGYTVSKYGLGTLTSLGKLIGVFYLIVLLFFLLVLWPVSRYAGVSLLKVLRYFRAELLLVLGTSSSESVFPQLTSKLERLGVEQSVVGLVLPTAYSFNHDGTCLYFASVSVFLAQATGTDLGWQAQIGLLLILLLTSKGGAGVSGSAIAVLALTLSSTHKIPVDSIALVLGIHSILSAAFVFTNIAGNCVATLVVGKWENAIDRVRLHKELDAGFTTAA

SEQ ID NO: 33 - DNA, 795 bp, Streptomyces sp. SN-593
  CDS (121)..(792)
gccaccgccccaccacgtcaccgcgcgtccggcggaccctgccgaacagcgcgtgcgaccgcgggtcggccggatatattttcccggcggacaacagcggaactcaacgaggcggtcgcagtggcgcaggaccggaagtcggggcgggcggggcggagcgcggtgcagcagggcgtccgccaggcgctcgcggccggggacatggttcccggccagcggctggtggagcaggagttgtcggacggcttcggcgtcacccgcagttcggtccgcgaggccctccaggaactggccgccgaggggctggtggaactggtcccgaaccggggcgcgcgggtccgcgtggtctcgatcgaggacgccgtgctgatcacggagtgccgctccgccctcgaagtcctgtgtgcgcggcgggcggccgtccacgcgacggacgacgaccggcaggcgctcggcgggatcggggagggcatgcgcgcggccgtcgcggaaggcgccctggacacctactccgccctcaatcgccgcctgcacgagcgggtggccgccgcgagcggccagacggtggccgagtcgctgctcgaccggctcaacgcccagatggtgcgccaccagttccggttggccgcccgcgcgggccggcccgcccagtcgctcccccagcacctggcgatcatcgacgcgatcgtggccggggacccggacgccgccgagaaggcgacgcgggcacacctcgacagcgtcctggaacaggtgcgcgccaccgccggcggcgccccctccctcgtcccctga

SEQ ID NO: 34 - protein, 224 aa, Streptomyces sp. SN-593
MAQDRKSGRAGRSAVQQGVRQALAAGDMVPGQRLVEQELSDGFGVTRSSVREALQELAAEGLVELVPNRGARVRVVSIEDAVLITECRSALEVLCARRAAVHATDDDRQALGGIGEGMRAAVAEGALDTYSALNRRLHERVAAASGQTVAESLLDRLNAQMVRHQFRLAARAGRPAQSLPQHLAIIDAIVAGDPDAAEKATRAHLDSVLEQVRATAGGAPSLVP

SEQ ID NO: 35 - DNA, 954 bp, Streptomyces sp. SN-593
  CDS (121)..(951)
ttgacagccgatgcgtcgcctgccgtatgctgcggaagaccactttagaattcacattcactcgcaccggatatactcgaatccactccctgttcgcacgcgttttccgtgggggaagcattggacatcgggattctcgggcccctggtcgtcggcgccagcgaccgggacgcggcaccgagcgcaccaaagccccggcaattactggcgttactcgcggttcgggccggccgcgtcgtccccgtcgacctgctggtcgaggaactgtgggaaagctctcccccgccgagcgcgctcaccacggtgcagacctacatcgtgctgctgcggcggctgctggcgaaatgcctccgggtgagcagcgccgcggtggcccaggaggtgctaacgtacaccggctggggataccagttgtcggcggacgaaggcacccacgacgccacggacttcgcccggcacgccgctctcgggcgccgtgcactggccgaaggcgacaacggccgggcctcggcggcgttgcgcgaggcactcgcccgctggcgcggaccggcactggtggacgtgcgcaccggcccgcacctgctggcccatcaggtgtcgctcgaggaacagcgcatgggcaccgtggagcagcgtattgaggccgatctgcggctggggcgccatcacgaagtgataggcgaactgtccggcctcgtggtgcagcacccgctgcacgagaatatccactcgctattgatggtcgcgctgtaccggtcgggccggccggggcaggcgctggcgactttccagcagcttcaccagaacctgcgcgacgaattgggaatggagccgtcgccgcgtatccggacggtccagcagggaattctgcgccgggactcgtcgttggaggccgtcgaggagtccaagctgttcctccagcaactgacggccccctcgcggccggcggggtga

SEQ ID NO: 36 - protein, 277 aa, Streptomyces sp. SN-593
MDIGILGPLVVGASDRDAAPSAPKPRQLLALLAVRAGRVVPVDLLVEELWESSPPPSALTTVQTYIVLLRRLLAKCLRVSSAAVAQEVLTYTGWGYQLSADEGTHDATDFARHAALGRRALAEGDNGRASAALREALARWRGPALVDVRTGPHLLAHQVSLEEQRMGTVEQRIEADLRLGRHHEVIGELSGLVVQHPLHENIHSLLMVALYRSGRPGQALATFQQLHQNLRDELGMEPSPRIRTVQQGILRRDSSLEAVEESKLFLQQLTAPSRPAG

SEQ ID NO: 37 - DNA, 1122 bp, Streptomyces sp. SN-593
  CDS (121)..(1119)
gatagtgctgctgcgccgcggggcgctgccgaagacctccagcggcaaggtgcagcgccggctggcccgcagccgctacctggacggcgagttcggcccggcaccggcgcgggaggcgtgatggcgggcacgatcggcacggccgccggggccgccggctcgcgcatcctgggcgtcggcgcgtaccggcccggccgggtggtgccgaacgacgaactcgtggagctgatcgactccagcgacgagtggatccgccggcactccgggatcgtctcgcgccgcttcggcgacgcggaggagaccgtggtcggcatggcggtcgccgcgtcgctcaaggcgctcgcccaggccggggtggccgccgaggaggtggacatggtcctgctggcgaccatgtcccacctggagcagtcccccgccgccgcgccgcagatcgcccacctgacgggtgcctcgtcggccggcgcgatggacgtgagcgcggcctgcgccggcttcgtgcacgcgctggcggtggccgacgcgctgatcaggacgggggccgcccggcgggtgctggtggtcggctcggagaagatgaccgacatcatcgacctgcgggaccgggcgaccgcgttcctgttcggcgacggcgccggagcggtcgtggtcgggcccgccgacaccccggggatcggcccggtggtctgggggtccgacggcggacaccgggaggccatcgcgcactccggttcgtggttggaactgcgggacggccaggccgcctggccgaccctgcggatgaacggccccagcgtctaccggtgggcgatagggaccgtcccgcaggtctgccgccgggcgctcgccgcggcagggaccgaccccgcggaactgggcgcgttcatcccgcaccaggccaacctgcgcatcgtcgacgccgcggtggccgccctcggactgcctccccatgtggcggtgtcccgggacgtgacggacaccggcaacacctcggccgcctccatcccgctggcgatggaacgcatggtggcccagggccgggccggcagcggcgacctcgccctgctcgtcggcttcggagccgggctgacgcacgccgcgatggtggtcgccctgccctga

SEQ ID NO: 38 - protein, 333 aa, Streptomyces sp. SN-593
MAGTIGTAAGAAGSRILGVGAYRPGRVVPNDELVELIDSSDEWIRRHSGIVSRRFGDAEETVVGMAVAASLKALAQAGVAAEEVDMVLLATMSHLEQSPAAAPQIAHLTGASSAGAMDVSAACAGFVHALAVADALIRTGAARRVLVVGSEKMTDIIDLRDRATAFLFGDGAGAVVVGPADTPGIGPVVWGSDGGHREAIAHSGSWLELRDGQAAWPTLRMNGPSVYRWAIGTVPQVCRRALAAAGTDPAELGAFIPHQANLRIVDAAVAALGLPPHVAVSRDVTDTGNTSAASIPLAMERMVAQGRAGSGDLALLVGFGAGLTHAAMVVALP

SEQ ID NO: 39 - DNA, 1860 bp, Streptomyces sp. SN-593
  CDS (121)..(1857)
ccgaggagggactcggcgtcaccgacccccagctacgcgcccggctgggtgagcagaagctcaacccgctccggtccgtgtaaccgggcccatcaggaggagttagcccacgtgaccgccatggaactcgccctgccggccgagttggcccccaccctgcccgaggcgttgcggctgcggagcgagcagcagccggacaccgtcgcgtacgtcttcctgcgcgacggcgagacccccgaggagaccctgacctacggacggctcgaccgggcggcccgggcccgggcggccgcgctggaggcggcggggctggccggcggcaccgccgtcctgctgtacccgtccggcctggagttcgtcgccgcgctgctcgggtgcatgtacgccgggaccgcgggcgcgcccgtgcaggtgccgacccggcgccgcggcatggagcgcgcgcgccgcatcgccgacgacgcgggcgcgaagacgatcctcaccacgaccgccgtcaagcgggaggtggaggagcacttcgccgacctgctgaccgggctgacggtgatcgacaccgagtcgctgccggacgtcccggacgacgccccggccgtgcgcctccccggcccggacgacgtcgcgctgctccagtacacctcgggctccaccggggaccccaagggcgtcgaggtcacgcacgccaacttccgcgccaacgtggcggagaccgtggagctgtggcccgtgcgctccgacgggacggtggtcaactggctgccgctcttccacgacatgggcctgatgttcggcgtggtgatgccgctgttcaccggcgtccccgcctacctgatggccccgcagtcgttcatccggcggccggcgcgctggctggaggcgatctcccggttccgcggcacccacgccgccgcgcccagcttcgcctacgagctgtgcgtgcgctcggtcgccgacaccggcctgcccgccgggctggacctgtcctcctggcgggtggcggtcaacggcgccgaaccggtgcgctggacggccgtggcggacttcaccgaggcgtacgccccggccggcttccgcccgcaggcgatgtgcccggggtacggcctggccgagaacaccctgaagctcagcggcagcccggaggaccgcccgcccaccctgctgcgcgccgacgccgccgcgctccaggacggccgggtggtgccgctgaccgggccggggacggacggtgtgcggctggtggggtccggggtgaccgtgccctcctcgcgggtggccgtcgtggaccccggcaccggcacggagcagccggccggccgggtcggcgagatctggatcaacggcccctgcgtggcccgcggttaccacgggcggccggcggagagcgccgagtccttcggcgcccggatcgccgggcaggaggcgcgcggcacctggctgcggaccggcgacctgggcttcctgcacgacggcgaggtcttcgtcgccggccgcctgaaggacgtggtcatccaccagggccgcaacttctacccgcaggacatagagctgtcggcggaggtgtcggaccgggcgctgcaccccaactgcgccgcggccttcgccctggacgacgggcggaccgagcggctggtgctcctggtcgaggccgacggccgggcgctgcgcaacggcggcgccgacgcgctgcgggcgcgggtgcacgacgcggtctgggaccggcagcggctgcggatcgacgagatagtgctgctgcgccgcggggcgctgccgaagacctccagcggcaaggtgcagcgccggctggcccgcagccgctacctggacggcgagttcggcccggcaccggcgcgggaggcgtga

SEQ ID NO: 40 - protein, 579 aa, Streptomyces sp. SN-593
MELALPAELAPTLPEALRLRSEQQPDTVAYVFLRDGETPEETLTYGRLDRAARARAAALEAAGLAGGTAVLLYPSGLEFVAALLGCMYAGTAGAPVQVPTRRRGMERARRIADDAGAKTILTTTAVKREVEEHFADLLTGLTVIDTESLPDVPDDAPAVRLPGPDDVALLQYTSGSTGDPKGVEVTHANFRANVAETVELWPVRSDGTVVNWLPLFHDMGLMFGVVMPLFTGVPAYLMAPQSFIRRPARWLEAISRFRGTHAAAPSFAYELCVRSVADTGLPAGLDLSSWRVAVNGAEPVRWTAVADFTEAYAPAGFRPQAMCPGYGLAENTLKLSGSPEDRPPTLLRADAAALQDGRVVPLTGPGTDGVRLVGSGVTVPSSRVAVVDPGTGTEQPAGRVGEIWINGPCVARGYHGRPAESAESFGARIAGQEARGTWLRTGDLGFLHDGEVFVAGRLKDVVIHQGRNFYPQDIELSAEVSDRALHPNCAAAFALDDGRTERLVLLVEADGRALRNGGADALRARVHDAVWDRQRLRIDEIVLLRRGALPKTSSGKVQRRLARSRYLDGEFGPAPAREA

SEQ ID NO: 41 - DNA, 1452 bp, Streptomyces sp. SN-593
  CDS (121)..(1449)
gcgctcaccgcgccgtgcgcggggccgaaggttaggggtgtctatcgcaaacgtactcccgtagcttcgtcctcgtcatcctgcatgtcaggaatttcgtccggcccgaggtgaggctacatggaacccatgaccgaggcagtgctccggggcgccgacccggacgagttgagccgaattccggtccccgaggacttcgtcgccgcgcatctgcgggccgaggacgccgacgcgttcatcggcatggacagcgccagcaaggacgtgcgcaagtcggtgcgggtgggccgggtgccgatgccggaactggcgcccgacgaggtgctggtggccgtgatggccagctccatcaactacaacaccgtgtggtcggcgatgttcgagcccatctcgaccttcgacgcgctgaagcggctgggccgcggcggcggttgggacgcgcggcacgaccagccgtaccacgtgctcggctcggacgcgtccggcgtcatcgtgcggaccggctccggggtgcgccgctggaaggtgggcgaccgggtctccgtctcccccgtggtggcggacaccgaggacccccgcacccacaacgacagcctgctctccgacatgtgggcgtggggctacgagaccaacttcggcggcctggcgcactactcggtggtccgctccgcccagctcatgcccaagcccgcccacctgagctgggaggaggccgcctgcatcccgctgtgcggcggcacctcctaccggatgctgatcggcgagcacggcgcccggatgaagcagggcgacatcgtgctgatctggggcgcgaccggcgggctcggctcgttcgccgtccagatggtcaagaacggcggcggcgttccgatcggcgtggtcagctcggagcgcaaggcggagatcgcccgcaagctcggctgcgacgtcgtgatcaaccgccaggagatcggcatcggcacgcagccggagcccgggccggcgacggtgaaactcgccaagcggctgggccgcgcgatccgccaggaggtgggcgaggacccgcacatcgtcttcgactacatcggcaaggccaccttcggcatgtcggtcatcgtggtccgccgcggcggcgccgtcgtcacctgcgggtcgagctccggcttcgagcacaactacgacaaccgctacctgtggatgaacctcaagcgcatcatcggcagccacgggatgaacctcagcgaggcgaccgagacgatgcggctgagcaagctcggcaagctctccccggtcctgtccgcggtgtacccgctcgccgaggccggcgaggcgacccggctggtgcagacgaacgcgcacaccggcaaggtcggcgtgctgtgcatggcacccgaggagggactcggcgtcaccgacccccagctacgcgcccggctgggtgagcagaagctcaacccgctccggtccgtgtaa

SEQ ID NO: 42 - protein, 443 aa, Streptomyces sp. SN-593
MEPMTEAVLRGADPDELSRIPVPEDFVAAHLRAEDADAFIGMDSASKDVRKSVRVGRVPMPELAPDEVLVAVMASSINYNTVWSAMFEPISTFDALKRLGRGGGWDARHDQPYHVLGSDASGVIVRTGSGVRRWKVGDRVSVSPVVADTEDPRTHNDSLLSDMWAWGYETNFGGLAHYSVVRSAQLMPKPAHLSWEEAACIPLCGGTSYRMLIGEHGARMKQGDIVLIWGATGGLGSFAVQMVKNGGGVPIGVVSSERKAEIARKLGCDVVINRQEIGIGTQPEPGPATVKLAKRLGRAIRQEVGEDPHIVFDYIGKATFGMSVIVVRRGGAVVTCGSSSGFEHNYDNRYLWMNLKRIIGSHGMNLSEATETMRLSKLGKLSPVLSAVYPLAEAGEATRLVQTNAHTGKVGVLCMAPEEGLGVTDPQLRARLGEQKLNPLRSV

SEQ ID NO: 43 - DNA, 2892 bp, Streptomyces sp. SN-593
  CDS (121)..(2889)
gctctccatcagcaccaggaatgcacacgcacctcacacgcaccgaatggcgaccggacgccggccggagcagaacccttgcgagacgccgcaacgaccaacagaggggttcccaggaacatgctggagcgcgaccaatgcctcgaccagctcacagaactgctcgacacatgcgccgaggggaacggcgcgacgggtgtcatcagcggtgcggtcgggttcggcaagaccacgctgctggaggccgtggtgtccagagccgcggcacgcgggtacatggtgctcggtgcggtcggctccaaggtggagagcgcgatcccgtacgcggtggtggagcagctcttccagagcgctgaactcgccggcgccgagaccgacctgcacgtcccgttacaacgggccaaggaggagtggtcccacctcggcatggaggcgggagcggcccaggccatgcaggcgtaccacgcgctgctggtcgaactcagcgcgcaccagccggtcgtgctgtgcgtcgacgacatccagcacgtcgactccgagtcgctggcctgcctgctctacctgatccggcgctgccgccggaacccggtcaccatcctcctcacgctcggcccgtccggggccgcgccctgcgagggggtgctcgccgaactggcgtgccggcccggtgtcgcgcacgtgcggctgggcgccttcgacgaggtgggcatggcccggctgatagcggaccggttcggaccggcggccgcggagcagtacgcacccgggttctacgcgatgagcggcggcaacccgctgctggcgcaggccctggtcagcgaccacaccgcccggcccgcgcaccccgagaccggctaccacccggtcgccgccgacctgttccgcgaggcgtcggtggcctgcacccgccgcagcggcctgaacgggctgcgggtggcccgggggctggcgatcaccaacggcgccggctcgtccacgctgctcgcccggctggtcgggctggagaagcgcgacgtggacgcggcgatgaagatcctcaccgagtcccggctgatcgaggggctccgcttccgccacccggcgatccgctcggccgtgctggacaacatgtcggccgtggaccgcacccggctgcaccaccgggtcgccgggctgctgcgcaacgacggcgcgcccgtcatcgtggtcgcgcagcacctgatcgccgcgggcgccgtggaggacgactgggcgccgcagttcctgatggacgcggccaagcaggcgttgcgcgaggaccgggtctccctcgcggagcagtgcctgcaactggccgacaactgctgccaggaccagggccgcagccatgccatcaaggcgaacctggcgcgcatcaagtggcgggaccagcccgaggcggccgcgcgcatcatgctgtccctggtcgccccggccagggccggggacctgccggggtccctgcgcctgaaggtcgcccaccggctgctggtgcagggccgggtcaccgacgcggtcgaactgatggggccgctgttcgccggaggcgccgacgggacaccggcggagcggctcacgctggagctggacgtgacccggctgtggctggccttcacctaccccggggtccaccagcaactcgtgggcgacctcccgccggagcagcagcggcaggtgccctcgcaccagatcgggcggccccggctgtcggccatccacacgctctgggcggtcctcaagcgcggccccgacgacgtgctggtggccgaggcggagcgggtgctccagcacctgctggccgaggacgacaccatcagctcgttgaactccgcgatcgcggcgctggtctacgccgaccggctggagtcggcggccgcctggtgcggccggctccagacggccgccaccgagcgccacgcccccacctggcacgccctgttcacctcgacacgggcgatgatcgcgctgcgccggggctcgctgcgcagtgccgcggagtccgcggaggccgcgctgcgcagtatgtcggtggaggcatggggcgtcgagatcggcatgccgctggccaccgcgatcgaggcccggacggcgatgggggaccacgcggccagcgccgaactggtcaacagcccggtcccgccgggcctgttccagacccggttcgggctgcactacctctacgcccgtggccgccactacctggccaccggctactacgacgcggccctcgcggacttcatccagtgcggcgagaaggcgcaggagtgggacctcgactctccggcgctggcgccctggcggaccggggcggtggaggtgtggctccagcgcgggcagcgcgagcgcgccggccggctggccgacgagcacctcgcgctggtcaagcgggggcagcgccgcaccctgggggtcgcgctgcgggtgcaggccatgacgcggccctcgtcgcagcaggcccacctgctgggcacggcggtggacatgctccagaccgccggggaccgctacgagctggcgctgacgctggtcgagctgtgccggacgcaccagcggcagggcgcggccgcgcaggcacggctgctggtccgccaggcgtggcggatggccagcgagtgcggcgccgaggggctgtgctcgtcgctgatgcccaagccggtcgccggtgtcccggtggagcagccgcgcagcctgccgccgtccgacgacgtggtggcgggggtgctctccgaggccgagctgcgggtgtgttcgctcgcggcccgcggccacaccaaccgggagatctccgacaagctcttcgtgacggtcagcaccgtcgagcagcacctgacccgggcctaccggaagctcaacatacggcaccgccgcgagctgccggccagcctcgcgtcctga

SEQ ID NO: 44 - protein, 923 aa, Streptomyces sp. SN-593
MLERDQCLDQLTELLDTCAEGNGATGVISGAVGFGKTTLLEAVVSRAAARGYMVLGAVGSKVESAIPYAVVEQLFQSAELAGAETDLHVPLQRAKEEWSHLGMEAGAAQAMQAYHALLVELSAHQPVVLCVDDIQHVDSESLACLLYLIRRCRRNPVTILLTLGPSGAAPCEGVLAELACRPGVAHVRLGAFDEVGMARLIADRFGPAAAEQYAPGFYAMSGGNPLLAQALVSDHTARPAHPETGYHPVAADLFREASVACTRRSGLNGLRVARGLAITNGAGSSTLLARLVGLEKRDVDAAMKILTESRLIEGLRFRHPAIRSAVLDNMSAVDRTRLHHRVAGLLRNDGAPVIVVAQHLIAAGAVEDDWAPQFLMDAAKQALREDRVSLAEQCLQLADNCCQDQGRSHAIKANLARIKWRDQPEAAARIMLSLVAPARAGDLPGSLRLKVAHRLLVQGRVTDAVELMGPLFAGGADGTPAERLTLELDVTRLWLAFTYPGVHQQLVGDLPPEQQRQVPSHQIGRPRLSAIHTLWAVLKRGPDDVLVAEAERVLQHLLAEDDTISSLNSAIAALVYADRLESAAAWCGRLQTAATERHAPTWHALFTSTRAMIALRRGSLRSAAESAEAALRSMSVEAWGVEIGMPLATAIEARTAMGDHAASAELVNSPVPPGLFQTRFGLHYLYARGRHYLATGYYDAALADFIQCGEKAQEWDLDSPALAPWRTGAVEVWLQRGQRERAGRLADEHLALVKRGQRRTLGVALRVQAMTRPSSQQAHLLGTAVDMLQTAGDRYELALTLVELCRTHQRQGAAAQARLLVRQAWRMASECGAEGLCSSLMPKPVAGVPVEQPRSLPPSDDVVAGVLSEAELRVCSLAARGHTNREISDKLFVTVSTVEQHLTRAYRKLNIRHRRELPASLAS

SEQ ID NO: 45 - DNA, 1098 bp, Streptomyces sp. SN-593
  CDS (121)..(1095)
cccgtgaacaccaacgctcccatgcgtccatcgtgtcaaatcgcttgacgatgcgagattcattgtctgacaatcaccggcggactgctgtgccaggttcgtgacagggagttgagagccgtgtcctcgctgaagtcgacgttcaccgtctatccgcacacccgggcgctggccgagggcgccgtcgagctgcccggcggcccgctggagttcgtcccgacgaagccgatcatccgggcctaccgcgagatggtccgcgaactcgcgtacgacgtgtgcgagttggcgccgaccacgtatctgatggcacgcgccgccggcgtgccggtgatcgccgtcccggtcttcaccaagcggctcttccaccacgggcacatccgctgccatgccgcgtccggcatccgggtgcccggcgacctcgtcggccgcacggtcggtgtgcgcgcctactcggtgaccaccggagtgtgggtacgcggcctgctgtcagacgatttcggcgtcgacccggccgaggtccgctgggtcaccgacgacgaggagcacgtcgcgagctacgtcgcgccgccgaacgtctcggcggtcgcgcccggcgagagcctggtggacctgctcgaccagggccggatcgacgccgcgctgaccggcaacgccggggtcggccgcaagggcgcgcccaaggacggctggacgaccggcgacagcggcccgcggcccgccgccgaaccgccctactcgctgttcggcacccccgagccgctggagcgggactggtaccgccgcaccggcgtctacccgatccacggcgtgatcgtggtgcgcgaagaactggtgcgcgacaacccccggctcgccaccgacctgtacgcggccttcgccgccgcgaagcgcgccgccggggccggccgcgccgaactcgtcgccgcgctcgccgccggcgcggccgtcccggacgacgaggacccgatcccctacggcgtcgagccgaacgcccggtccctggaggccctcatccgctacgcccgcgagcagcacctgctcgacaccccggtgtcggtcgaggagatcttcgcgcccggcgactacccgacggcctga

SEQ ID NO: 46 - protein, 325 aa, Streptomyces sp. SN-593
MSSLKSTFTVYPHTRALAEGAVELPGGPLEFVPTKPIIRAYREMVRELAYDVCELAPTTYLMARAAGVPVIAVPVFTKRLFHHGHIRCHAASGIRVPGDLVGRTVGVRAYSVTTGVWVRGLLSDDFGVDPAEVRWVTDDEEHVASYVAPPNVSAVAPGESLVDLLDQGRIDAALTGNAGVGRKGAPKDGWTTGDSGPRPAAEPPYSLFGTPEPLERDWYRRTGVYPIHGVIVVREELVRDNPRLATDLYAAFAAAKRAAGAGRAELVAALAAGAAVPDDEDPIPYGVEPNARSLEALIRYAREQHLLDTPVSVEEIFAPGDYPTA

SEQ ID NO: 47 - DNA, 20 bp, Artificial sequence
  Synthetic sequence KS-F1
tsgcsatggacccscagcag

SEQ ID NO: 48 - DNA, 20 bp, Artificial sequence
  Synthetic sequence KS-R1
ccsgtrccgtgcgcctcsac

SEQ ID NO: 49 - DNA, 20 bp, Artificial sequence
  Synthetic sequence KSAT-F1
gtcgacacsgcctgytcstc

SEQ ID NO: 50 - DNA, 23 bp, Artificial sequence
  Synthetic sequence KSAT-R1
gcggcgatctcgccctgsgagtg

SEQ ID NO: 51 - DNA, 23 bp, Artificial sequence
  Synthetic sequence ER-F1
gtgggcstgaacttccgcgacgt

SEQ ID NO: 52 - DNA, 24 bp, Artificial sequence
  Synthetic sequence ER-F2
gacgtgstgamcgscctcgggatg

SEQ ID NO: 53 - DNA, 23 bp, Artificial sequence
  Synthetic sequence ER-F3
gcsggsgtcgtcaccgccgtcgg

SEQ ID NO: 54 - DNA, 24 bp, Artificial sequence
  Synthetic sequence ER-R1
cggcagcaaccgcagcgasgcgtc

SEQ ID NO: 55 - DNA, 24 bp, Artificial sequence
  Synthetic sequence ER-R2
ggtcttgcccatctcsasgaascg

SEQ ID NO: 56 - DNA, 21 bp, Artificial sequence
  Synthetic sequence ER-R3
gacgaccttgcccacatgacg

SEQ ID NO: 57 - DNA, 38 bp, Artificial sequence
  primer
ccggaattcggatccgccggctgcacgaggagtcgtcg

SEQ ID NO: 58 - DNA, 38 bp, Artificial sequence
  primer
cccaagcttggcgcgcctcgggtgcgtcctgcgcggtg

SEQ ID NO: 59 - DNA, 39 bp, Artificial sequence
  primer
cccaagcttggcgcgcctgcccgacgtgatcgacgacgc

SEQ ID NO: 60 - DNA, 34 bp, Artificial sequence
  primer
ccgctcgagggatccagcccctcggccaccgaca

SEQ ID NO: 61 - DNA, 35 bp, Artificial sequence
  primer
ctcgagaagcttcagtgagttcgagcgactcgaga

SEQ ID NO: 62 - DNA, 33 bp, Artificial sequence
  primer
ctcgagaagcttctggtaccgagcgaacgcgta

SEQ ID NO: 63 - DNA, 59 bp, Artificial sequence
  primer
atgacgcgacgactcgacggtaaggtggccatgatcacgattccggggatccgtcgacc

SEQ ID NO: 64 - DNA, 58 bp, Artificial sequence
  primer
ttacggggtggtgaagccggcgtcgatcggcagcgcgattgtaggctggagctgcttc

SEQ ID NO: 65 - DNA, 59 bp, Artificial sequence
  primer
atgaagggagtcgccgcgcggctccacgtcggcgcccggattccggggatccgtcgacc

SEQ ID NO: 66 - DNA, 58 bp, Artificial sequence
  primer
atcgctcgcccgcaactgcgcgatgacgccggccagctgtgtaggctggagctgcttc

SEQ ID NO: 67 - DNA, 59 bp, Artificial sequence
  primer
gtgtcctcgctgaagtcgacgttcaccgtctatccgcacattccggggatccgtcgacc

SEQ ID NO: 68 - DNA, 58 bp, Artificial sequence
  primer
tcaggccgtcgggtagtcgccgggcgcgaagatctcctctgtaggctggagctgcttc

SEQ ID NO: 69 - DNA, 33 bp, Artificial sequence
  primer
cccaagcttacgtggcgctgtcgttcgcgagct

SEQ ID NO: 70 - DNA, 33 bp, Artificial sequence
  primer
cccaagcttcccaccggctcatcgacgacatgc

SEQ ID NO: 71 - DNA, 33 bp, Artificial sequence
  primer
cccaagcttggtagcggttgtcgtgtccgtaga

SEQ ID NO: 72 - DNA, 33 bp, Artificial sequence
  primer
cccaagcttggagcaggagttgtcggacggctt

SEQ ID NO: 73 - DNA, 33 bp, Artificial sequence
  primer
cccaagcttggcgacgttctcgaagacgctcat

SEQ ID NO: 74 - DNA, 33 bp, Artificial sequence
  primer
cccaagctttcgacgacatccagcacgtcgact

SEQ ID NO: 75 - DNA, 34 bp, Artificial sequence
  primer
ccggaattcacagcttcacgctgccgcaagcact

SEQ ID NO: 76 - DNA, 34 bp, Artificial sequence
  primer
cgcggatcccatgcgaaacgatcctcatcctgtc

SEQ ID NO: 77 - DNA, 33 bp, Artificial sequence
  primer
cgcggatccatgacgcgacgactcgacggtaag

SEQ ID NO: 78 - DNA, 33 bp, Artificial sequence
  primer
cccaagcttttacggggtggtgaagccggcgtc

SEQ ID NO: 79 - DNA, 34 bp, Artificial sequence
  primer
ggaattccatatgacgcgacgactcgacggtaag

SEQ ID NO: 80 - DNA, 33 bp, Artificial sequence
  primer
ccgctcgagttacggggtggtgaagccggcgtc

SEQ ID NO: 81 - DNA, 34 bp, Artificial sequence
  primer
ggaattccatatggtgaccgagaccgaacagctc

SEQ ID NO: 82 - DNA, 30 bp, Artificial sequence
  primer
ccgctcgagtcagacccgggtgaggtcgac

SEQ ID NO: 83 - DNA, 33 bp, Artificial sequence
  primer
cccaagcttggacttcgcctgcgcgttgaactt

SEQ ID NO: 84 - DNA, 33 bp, Artificial sequence
  primer
cccaagcttaggcttcctggaggaagtccgtca

SEQ ID NO: 85 - DNA, 33 bp, Artificial sequence
  primer
ccgctcgagaacgccccggagggcatctactga

SEQ ID NO: 86 - DNA, 33 bp, Artificial sequence
  primer
ccgctcgagctggtcgaccagagccagtgattc

SEQ ID NO: 87 - DNA, 59 bp, Artificial sequence
  primer
ctgaccgtcgaccggatgctgcgctgggaactggaccgcattccggggatccgtcgacc

SEQ ID NO: 88 - DNA, 58 bp, Artificial sequence
  primer
gatgtcgagcttggccgggccgaggaggaacgcaagctgtgtaggctggagctgcttc

SEQ ID NO: 89 - DNA, 59 bp, Artificial sequence
  primer
gacaagcagctcgtgctgcgcgaggtcgaggaccccaggattccggggatccgtcgacc

SEQ ID NO: 90 - DNA, 58 bp, Artificial sequence
  primer
cggcagcaggaggatcttgccgacgtggtcgctcgcctctgtaggctggagctgcttc

SEQ ID NO: 91 - DNA, 59 bp, Artificial sequence
  primer
cacaccgacctggccgtccagcacgggttcacgcccttcattccggggatccgtcgacc

SEQ ID NO: 92 - DNA, 58 bp, Artificial sequence
  primer
gaacgtgtgcgggtcgctgtcgccctcgacgacgccgactgtaggctggagctgcttc

SEQ ID NO: 93 - DNA, 33 bp, Artificial sequence
  primer
cgcggatccatgaacgaatcactggctctggtc

SEQ ID NO: 94 - DNA, 33 bp, Artificial sequence
  primer
cccaagctttcagtagatgccctccggggcgtt

SEQ ID NO: 95 - DNA, 30 bp, Artificial sequence
  primer
ccggaattccaccgggatggtgacctccac

SEQ ID NO: 96 - DNA, 33 bp, Artificial sequence
  primer
cccaagctttcacgtgtgttgcgtccaggcttc

SEQ ID NO: 97 - DNA, 33 bp, Artificial sequence
  primer
cgcggatccatggacatcaccgcagcagtgatc

SEQ ID NO: 98 - DNA, 33 bp, Artificial sequence
  primer
cccaagctttcaccggtgcgtgagcaccacctt

SEQ ID NO: 99 - DNA, 1533 bp, Artificial sequence
  synthetic DNA
catatggcggaacatgtggacgtgttggtggtgggagcaggcttaagtggcattggagcggccggtcgcctgcgccgtgcagacccgcgtcgcaccttagccattctggaagcacgtgatgccgtaggtggtacctgggatctgttccgttatcctggtgtacgctcagactccgatatgcacacgttaggctatcagcaacgcccgtggaaggacccgaaagcgattgcagatggcgagtcaatcctgagctatatccgcgaaactgcccgtgaagatggcctgttggatcatgttcgctttcggcatcgcgtggttggcgctgattgggatgaagcgcatgcccgctggaatgttcgtgttgaacgtggtgctgaaggtgaagccgaggaaatcacgttgacctgcagctttctgtacctgtgtagcgggtactatcggtacgacgaaggctatagcccgcagttcaaggatgcggatcgttttggcgggcgcatagtacacccgcagcattggccagcggacctggactataccggcaaacgcgtagtcgtgatcgggtctggtgcgaccgcagttacactcgtgccggctatggcagcgcgtgccgctcacgtcaccatgttacaacgctctccgtcttacgtgatgtctctgccgagtcgcgacggcattgccggtgcgctgcgtcgcgttctgccagagcggacagcattagctgccattcgctggaagaacgctacgcttgcactgggcttctaccgctttagccgtaaacgcccggagaaggtcaaagccatgctgcgcaaaggagtggtcaaacagctgccggatggctatgacgtcgacacgcactttaccccgcgctatgcgccgtgggatcagcgcgtctgctacgtgcccgatggtgatcttttcaaagccattagtgccggtgaagcgtcggttgtcacggatcatgtggaatccttcacagaacgtggtctgctgttgcgttcgggtaaagaggtaccggcggatgtggtggtgactgcaactggcctgaatctgcttcccttgggtggcattcgcttgtcggttgccggccgcccggtcgaccctggggcgacggtggcatacaaaggcatgatgctgagtggggttcctaactttgcctggacgcttggctacaccaattccagctggaccctgaaagcggatctggtggcgcagtatgttagccgcctcctggcgcacatggcggaacgtgggcatgctgtcgtacgtccgctggccccaccggcgggagatgaggtgctgccaatcttagatctccggtcaggttatgtcctccgtggggcagataccatgccgaaacgtggcactcgcgcgccatggacactggagcaaaactatcggcaggacgtgcgccttctctggcgtggccccgttgatgacgcagttgaatttgcccctgcgccaagcggtgcacgtgctgcgggatcaggtgatgctcccgctcgccctgtaccggaaacctcgtcctaactcgag

The invention claimed is:

1. A bacterium belonging to the genus *Streptomyces* having an ability to produce reveromycin A or a synthetic intermediate thereof, wherein the synthetic intermediate is selected from the group consisting of

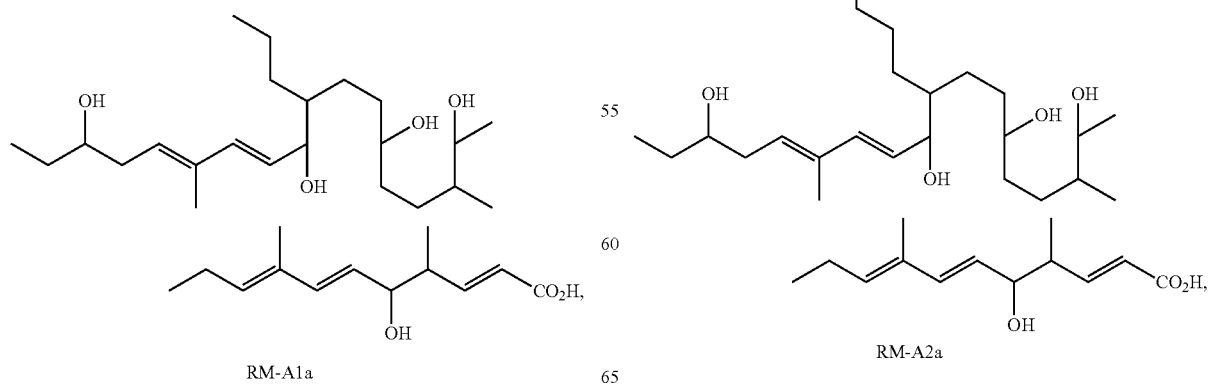

RM-A1a

RM-A2a

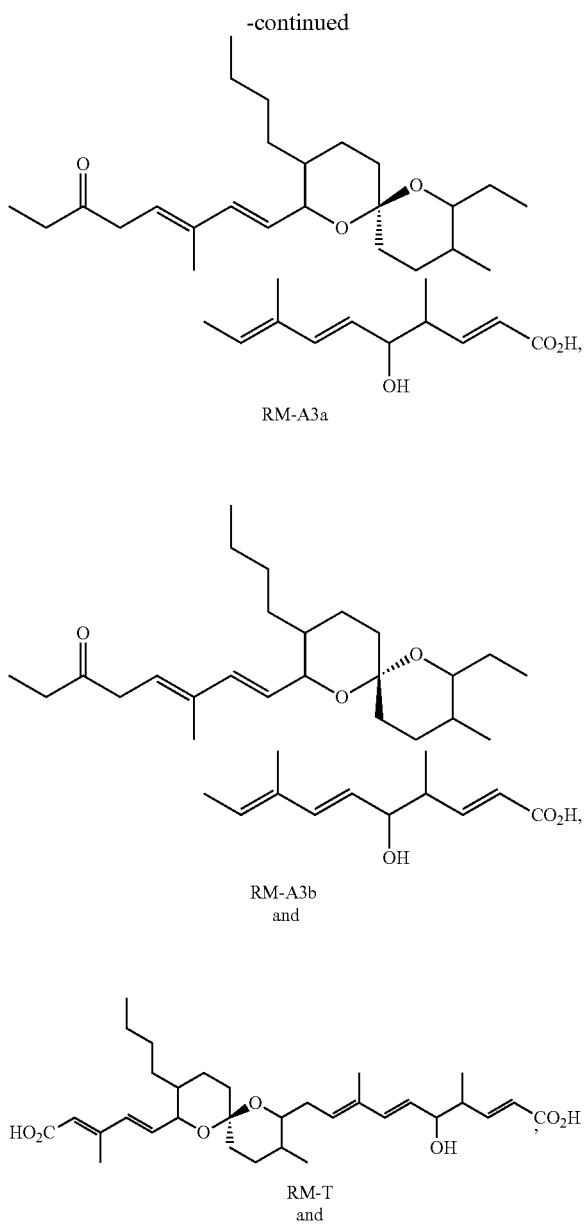

wherein the bacterium has been modified so as to increase expression of a revQ gene encoding (i) the amino acid sequence of SEQ ID NO: 36 or (ii) an amino acid sequence having not less than 90% identity to SEQ ID NO: 36 as compared with a parent strain, such that production ability of reveromycin A is increased as compared with the parent strain, and expression of the revQ gene has been increased by enhancing the copy number of the revQ gene or by modifying a promoter of the revQ gene.

2. The bacterium according to claim 1, wherein the bacterium has been obtained by modifying *Streptomyces* sp. SN-593 strain such that expression of the revQ gene increases.

3. The bacterium according to claim 1, wherein the bacterium has been modified so as to increase expression of the revQ gene encoding an amino acid sequence having not less than 95% identity to SEQ ID NO: 36 as compared with a parent strain.

4. The bacterium according to claim 1, wherein the bacterium has been modified so as to increase expression of the revQ gene encoding the amino acid sequence of SEQ ID NO: 36 as compared with a parent strain.

5. The bacterium according to claim 2, wherein the bacterium has been modified so as to increase expression of the revQ gene encoding an amino acid sequence having not less than 95% identity to SEQ ID NO: 36 as compared with a parent strain.

6. The bacterium according to claim 2, wherein the bacterium has been modified so as to increase expression of the revQ gene encoding the amino acid sequence of SEQ ID NO: 36 as compared with a parent strain.

7. A bacterium belonging to the genus *Streptomyces* having an ability to produce reveromycin A, wherein the bacterium has been modified so as to increase expression of a revQ gene encoding the amino acid sequence of SEQ ID NO: 36 as compared with a parent strain by enhancing the copy number of the revQ gene or by modifying a promoter of the revQ gene, such that production ability of reveromycin A is increased as compared with the parent strain.

8. A recombinant vector comprising a polynucleotide encoding (i) the amino acid sequence of SEQ ID NO: 36 or (ii) an amino acid sequence having not less than 90% identity to SEQ ID NO: 36,
  wherein when the vector is introduced in a bacterium belonging to the genus *Streptomyces* having an ability to produce reveromycin A or a synthetic intermediate thereof, the polynucleotide improves the production ability of reveromycin A,
  and wherein the synthetic intermediate is selected from the group consisting of

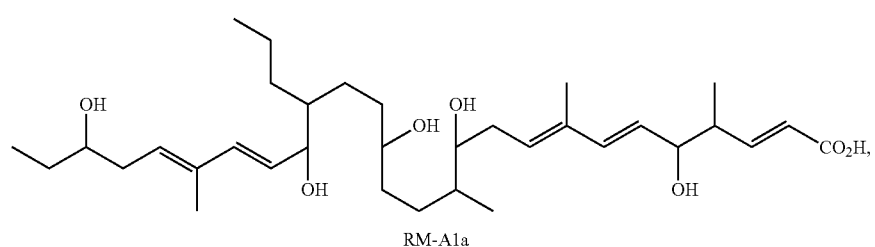

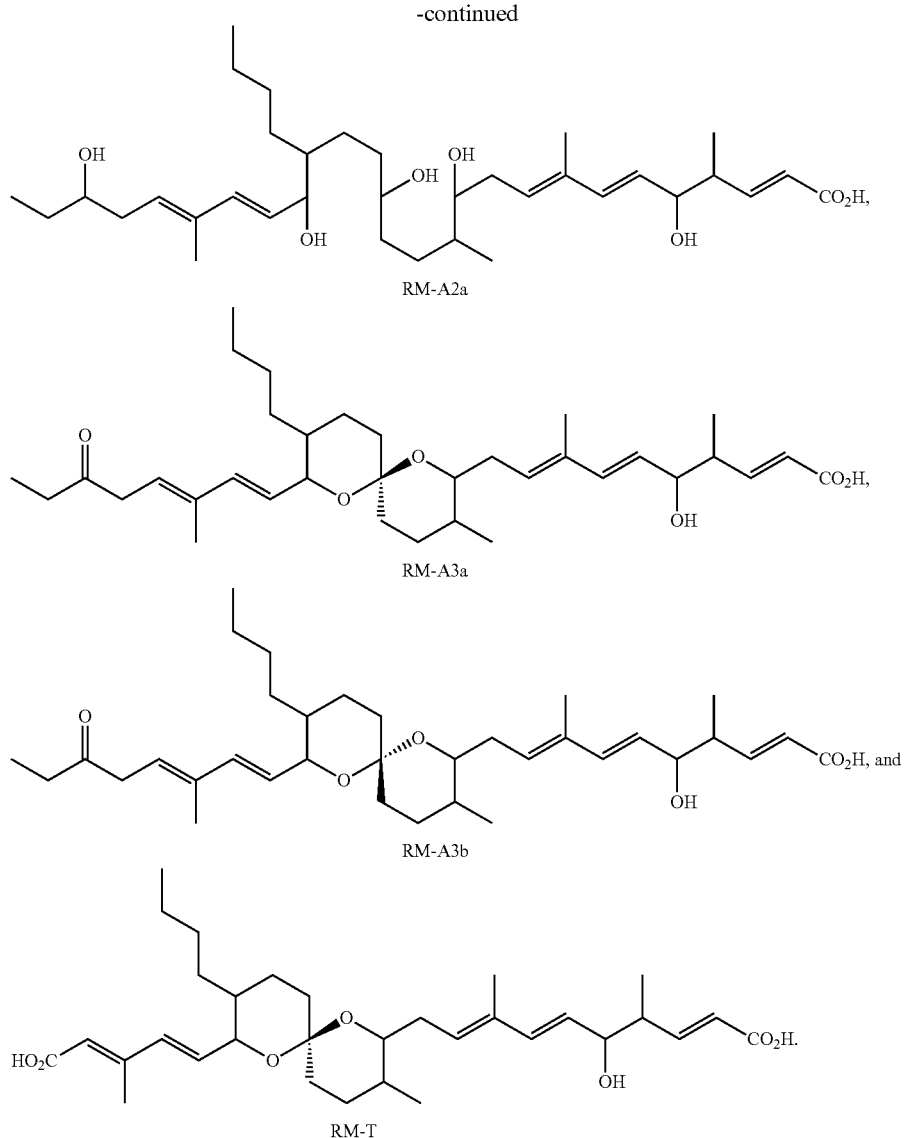

9. The recombinant vector according to claim 8, wherein the bacterium is a *Streptomyces* sp. SN-593 strain.

10. The recombinant vector of claim 8, wherein the polynucleotide encodes an amino acid sequence having not less than 95% identity to SEQ ID NO: 36.

11. The recombinant vector of claim 8, wherein the polynucleotide encodes the amino acid sequence of SEQ ID NO: 36.

12. A method of producing reveromycin A or a synthetic intermediate thereof comprising the steps of:
    culturing the bacterium belonging to the genus *Streptomyces* according to claim 1 in a medium to accumulate reveromycin A or the synthetic intermediate thereof in the medium, and
    collecting reveromycin A or the synthetic intermediate thereof from the culture.

13. A method of producing reveromycin A or a synthetic intermediate thereof comprising the steps of:
    culturing the bacterium belonging to the genus *Streptomyces* according to claim 2 in a medium to accumulate reveromycin A or the synthetic intermediate thereof in the medium, and
    collecting reveromycin A or the synthetic intermediate thereof from the culture.

14. A method of producing reveromycin A or a synthetic intermediate thereof comprising the steps of:
    culturing the bacterium belonging to the genus *Streptomyces* according to claim 3 in a medium to accumulate reveromycin A or the synthetic intermediate thereof in the medium, and
    collecting reveromycin A or the synthetic intermediate thereof from the culture.

15. A method of producing reveromycin A or a synthetic intermediate thereof comprising the steps of:
    culturing the bacterium belonging to the genus *Streptomyces* according to claim 4 in a medium to accumulate reveromycin A or the synthetic intermediate thereof in the medium, and
    collecting reveromycin A or the synthetic intermediate thereof from the culture.

16. A method of producing reveromycin A or a synthetic intermediate thereof comprising the steps of:
  culturing the bacterium belonging to the genus *Streptomyces* according to claim 5 in a medium to accumulate reveromycin A or the synthetic intermediate thereof in the medium, and
  collecting reveromycin A or the synthetic intermediate thereof from the culture.

17. A method of producing reveromycin A or a synthetic intermediate thereof comprising the steps of:
  culturing the bacterium belonging to the genus *Streptomyces* according to claim 6 in a medium to accumulate reveromycin A or the synthetic intermediate thereof in the medium, and
  collecting reveromycin A or the synthetic intermediate thereof from the culture.

18. A method of producing reveromycin A comprising the steps of:
  culturing the bacterium belonging to the genus *Streptomyces* according to claim 7 in a medium to accumulate reveromycin A in the medium, and
  collecting reveromycin A from the culture.

* * * * *